US008043839B2

(12) United States Patent
Weiner et al.

(10) Patent No.: US 8,043,839 B2
(45) Date of Patent: Oct. 25, 2011

(54) XYLANASES, NUCLEIC ACIDS ENCODING THEM AND METHODS FOR MAKING AND USING THEM

(75) Inventors: David Weiner, Del Mar, CA (US); David Blum, Nashville, TN (US); Alexander Varvak, San Diego, CA (US); Shaun Healey, Carlsbad, CA (US); Kristine Chang, San Diego, CA (US); Geoff Hazlewood, Newbury (GB); Thomas Todaro, San Diego, CA (US); Grace Desantis, San Diego, CA (US); Hwai Chang, San Marcos, CA (US); Connie Jo Hansen, San Diego, CA (US); Scott W. Beaver, San Marcos, CA (US); Thomas Woodward, Scottsville, VA (US); Charles Hancock, San Marcos, CA (US)

(73) Assignee: Verenium Corporation, San Diego, CA (US)

(*) Notice: Subject to any disclaimer, the term of this patent is extended or adjusted under 35 U.S.C. 154(b) by 0 days.

(21) Appl. No.: 12/279,326

(22) PCT Filed: Feb. 14, 2007

(86) PCT No.: PCT/US2007/004429
§ 371 (c)(1),
(2), (4) Date: Dec. 16, 2008

(87) PCT Pub. No.: WO2007/095398
PCT Pub. Date: Aug. 23, 2007

(65) Prior Publication Data
US 2009/0155238 A1 Jun. 18, 2009

Related U.S. Application Data

(60) Provisional application No. 60/773,122, filed on Feb. 14, 2007.

(51) Int. Cl.
*C12N 9/24* (2006.01)
*C12N 1/20* (2006.01)
*C12N 1/15* (2006.01)
*C12N 1/16* (2006.01)
*C12N 1/19* (2006.01)
*C12N 15/70* (2006.01)
*C12P 21/06* (2006.01)
*C07H 21/04* (2006.01)
*A01H 5/00* (2006.01)

(52) U.S. Cl. .................. 435/200; 435/69.1; 435/320.1; 435/252.3; 536/23.2; 800/298; 800/312; 800/314; 800/320; 800/320.1; 800/320.2; 800/320.3

(58) Field of Classification Search .................. None
See application file for complete search history.

(56) References Cited

U.S. PATENT DOCUMENTS

| | | |
|---|---|---|
| 5,116,746 A | 5/1992 | Bernier et al. |
| 5,179,021 A | 1/1993 | du Manoir et al. |
| 5,374,555 A | 12/1994 | Pokora et al. |
| 5,395,765 A | 3/1995 | Dahlberg et al. |
| 5,405,769 A | 4/1995 | Campbell et al. |
| 5,437,992 A | 8/1995 | Bodie et al. |
| 5,503,709 A | 4/1996 | Burton |
| 5,591,304 A | 1/1997 | Tolan et al. |
| 5,618,386 A | 4/1997 | Arbeloa et al. |
| 5,645,686 A | 7/1997 | Troughton et al. |
| 5,688,668 A | 11/1997 | Sjoeholm et al. |
| 5,736,384 A | 4/1998 | Fukunaga |
| 5,759,840 A | 6/1998 | Sung et al. |
| 5,785,811 A | 7/1998 | Pokora et al. |
| 5,866,526 A | 2/1999 | Olsen et al. |
| 5,916,795 A | 6/1999 | Fukunaga et al. |
| 5,935,836 A | 8/1999 | Vehmaanperä |
| 5,981,253 A | 11/1999 | Outtrup et al. |
| 6,015,703 A | 1/2000 | White et al. |
| 6,030,933 A | 2/2000 | Herbots et al. |
| 6,083,733 A | 7/2000 | Gronberg et al. |
| 6,140,095 A | 10/2000 | Williams et al. |
| 6,241,849 B1 | 6/2001 | Franks |
| 6,346,407 B1 | 2/2002 | De Buyl et al. |
| 6,365,390 B1 | 4/2002 | Blum |

(Continued)

FOREIGN PATENT DOCUMENTS

EP 0 473 545 8/1991

(Continued)

OTHER PUBLICATIONS

EP07751203.6—Extended EP Search Report—Jan. 22, 2010.
PCT/US2008/072030—IPRP—Apr. 7, 2010.
PCT/US2008/072030—ISR & WO—Aug. 20, 2009.
Grepinet—Journal of Bacteriology (1988)—170—4582-4588.
NCBI Accession No. M22759—Clostridium thermocellum—Apr. 26, 1993.
NCBI Accession No. AY502070—Nectria haematococca mpVI—Dec. 9, 2004.
Chen et al., Can J Microbiology (2001) 47:1088-1094.
Chen et al., Enzyme and Microbial Technology (1997) 20:39-45.

(Continued)

*Primary Examiner* — Anand Desai
*Assistant Examiner* — Iqbal H Chowdhury
(74) *Attorney, Agent, or Firm* — Kalim S. Fuzail

(57) ABSTRACT

The invention relates to enzymes having xylanase, mannanase and/or glucanase activity, e.g., catalyzing hydrolysis of internal β-1,4-xylosidic linkages or endo-β-1,4-ghicanase linkages; and/or degrading a linear polysaccharide beta-1,4-xylan into xylose. Thus, the invention provides methods and processes for breaking down hemicellulose, which is a major component of the cell wall of plants, including methods and processes for hydrolyzing hemicelluloses in any plant or wood or wood product, wood waste, paper pulp, paper product or paper waste or byproduct. In addition, methods of designing new xylanases, mannanases and/or glucanases and methods of use thereof are also provided. The xylanases, mannanases and/or glucanases have increased activity and stability at increased pH and temperature.

6 Claims, 28 Drawing Sheets

U.S. PATENT DOCUMENTS

| | | |
|---|---|---|
| 6,426,211 B1 | 7/2002 | de Buyl et al. |
| 6,555,350 B2 | 4/2003 | Ahring et al. |
| 2002/0174962 A1 | 11/2002 | Izumi et al. |
| 2004/0005674 A1 | 1/2004 | Duck et al. |
| 2004/0013322 A1 | 1/2004 | Taylor |
| 2004/0077071 A1 | 4/2004 | Tolan et al. |
| 2004/0112555 A1 | 6/2004 | Tolan et al. |
| 2005/0150619 A1 | 7/2005 | Tolan et al. |

FOREIGN PATENT DOCUMENTS

| | | |
|---|---|---|
| WO | WO-87/06609 | 11/1987 |
| WO | WO-91/05908 | 5/1991 |
| WO | WO-91/11553 | 8/1991 |
| WO | WO-92/03608 | 3/1992 |
| WO | WO-94/04664 | 3/1994 |
| WO | 94/24270 A2 | 10/1994 |
| WO | WO-95/27779 | 10/1995 |
| WO | 96/23062 A1 | 8/1996 |
| WO | 97/13853 A2 | 4/1997 |
| WO | 97/14803 A1 | 4/1997 |
| WO | 97/22691 A1 | 6/1997 |
| WO | WO-00/29587 | 5/2000 |
| WO | 00/39289 A2 | 7/2000 |
| WO | WO-01/18218 | 3/2001 |
| WO | 01/66711 A1 | 9/2001 |
| WO | 02/38746 A2 | 5/2002 |
| WO | WO-02/052100 | 7/2002 |
| WO | WO-02/057541 | 7/2002 |
| WO | 03/020923 A1 | 3/2003 |
| WO | WO-03/074780 | 9/2003 |
| WO | WO-03/093420 | 11/2003 |
| WO | WO-03-106654 A2 * | 12/2003 |
| WO | WO 2004/066945 | 8/2004 |
| WO | 2007/095398 A2 | 8/2007 |

OTHER PUBLICATIONS

Database EMBL [Online], EBI Accession No. EM_PRO:AB063255, Dec. 16, 2001.
Database UniProt Accession No. Q9KB30, Oct. 1, 2000.
Fushinobu et al., Protein Engineering (1998) 11(12):1121-1128.
George et al., Biochem. Biophys. Res. Commun. (2001) 282:48-54.
Henrissat et al., Biochem J (1993) 293:781-788.
Henrissat et al., Plant Physiology (2000) 124:1515-1519.
Joshi et al., J Mol Biol (2000) 299:255-279.
International Search Report for PCT/US03/19153, mailed on Jun. 22, 2004, 8 pages.
International Search Report for PCT/US07/04429, mailed on Aug. 15, 2008, 10 pages.
Kimura et al., Biosci Biotechnol Biochem (2000) 64(12):2734-2738.
Nielsen et al., Protein Engineering (1997) 10(1):1-6.
Non-Final Office Action for U.S. Appl. No. 10/517,939, mailed on Mar. 28, 2008.
Supplementary Partial European Search Report for EP 03 76 0440, mailed on Apr. 12, 2006.
Supplementary Partial European Search Report for EP 03 76 0440, mailed on Jun. 12, 2006, 7 pages.
Takami et al., GenBank Accession No. AP001514, Jan. 10, 2001, 159 pages.
Written Opinion for PCT/US03/19153, mailed on Jul. 21, 2005, 7 pages.
Written Opinion of the International Searching Authority for PCT/US07/04429, mailed on Aug. 15, 2008, 4 pages.
EP08797071.1—Extended EP Search Report—Aug. 10, 2010.
Arase—FEBS Letters (1993)—316—123-127.
Andrews—Journal of Biological Chemistry (2004)—279—54369-54379.
CIPO—Oct. 4, 2010—Office Action—CA 2488916.
Genbank Accession No. AAL57754—Nagy (2001).
Genbank Accession No. BAB79287—Kamei (2001).
Genbank Accession No. AF198618—Kanhiyur (1999).
Genbank Accession No. AB063255—Aoki (2001).
UNIPROT Accession No. Q9KB30—Takami (2000).
Genbank Accession No. AP001514—Takami (Jan. 10, 2001).
Genbank Accession No. BA000004—Takami (1999).
AUIP—Nov. 2, 2010—Examiner's First Report—AU 2008201402.
EPO—Dec. 17, 2010—Office Action—EP 03760440.2.
In Patent Office—Dec. 22, 2010—First Examination Report—in 0014/MUMNP/2005.
AUIP—Jan. 28, 2011—Examiner's Second Report—AU 2008201402.
EP10179289—Extended EP Search Report—Feb. 10, 2011.
EP10179307—Extended EP Search Report—Feb. 9, 2011.
EP10179325—Extended EP Search Report—Feb. 9, 2011.
FUSHINOBU—Protein Engineering (1998) 11—1121-1128.
Dalbøge—Trends in Biotechnology (1998) 16—265-272.

* cited by examiner

Figure 5: Thermal Tolerance of Wild-type Xylanase (SEQ ID NOS:189 and 190) vs. 8x Mutant Figure 7
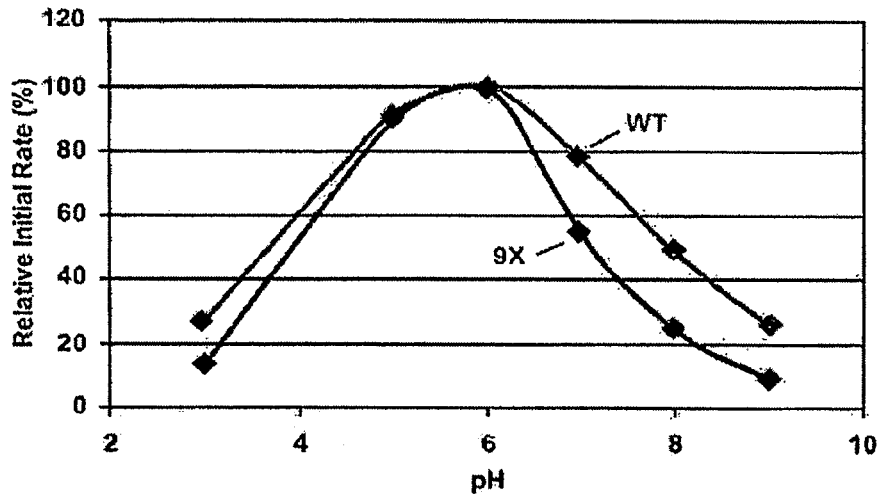
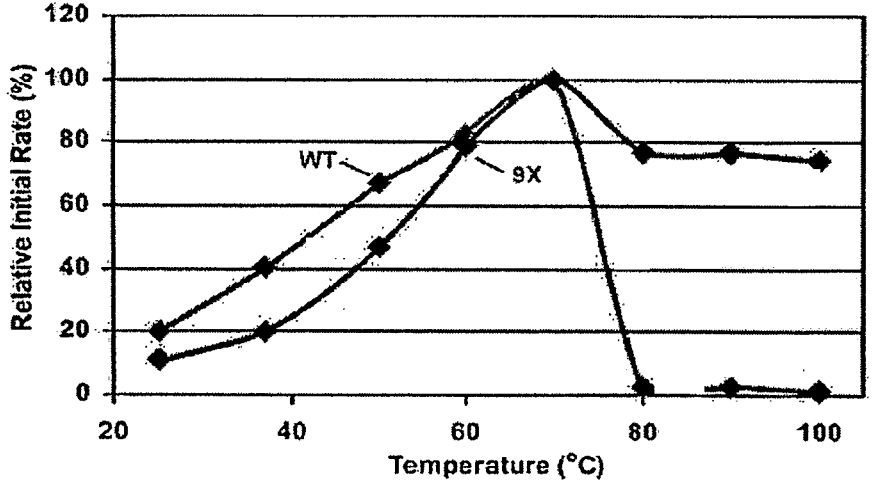
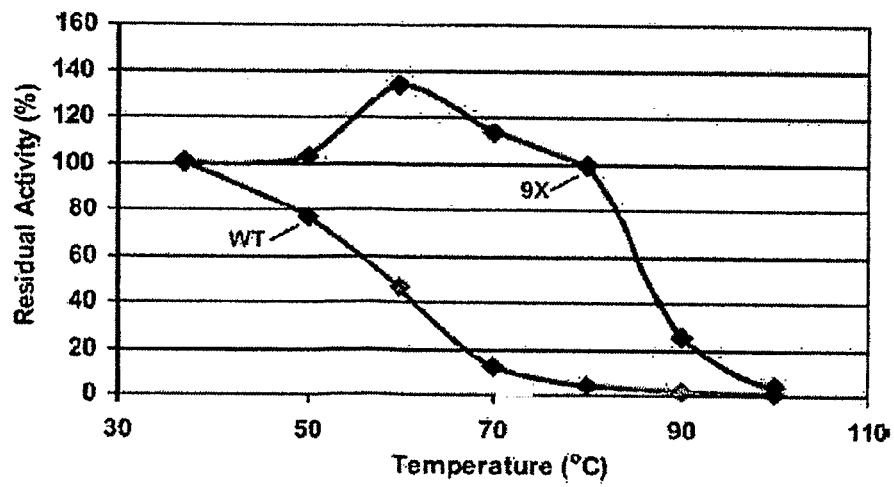

Biobleaching Results

Figure 15

| stage | consistency | duration(mins) |
|---|---|---|
| X | 10% | 60 |
| Do | 4.0% | 35 |
| E1 | 10% | 135 |

| | Low/High | 60 C pH 10 | | 80 C pH 10 | | 90 C pH 10 | | 60 C pH 8 | | 90 C pH 8 | |
|---|---|---|---|---|---|---|---|---|---|---|---|
| Enzyme No. | Kappa factor | Δ Brightness | % Chemical savings | Δ Brightness | % Chemical savings | Δ Brightness | % Chemical savings | Δ Brightness | % Chemical savings | Δ Brightness | % Chemical savings |
| 20 | 0.16/0.21 | 1.9 | 8.4 | 2.3 | 10.3 | | | 2.8 | 13.7 | 2.0 | 10.1 |
| 21 | 0.14/0.18 | 3.5 | | | | | | | | | 14.9 |
| 22 | 0.14/0.18 | | | | | 2.4 | 11.8 | | 13.2 | 1.9 | 9.3 |
| 23 | 0.14/0.18 | 2.9 | 14.2 | 2.2 | 10.8 | | | 2.7 | 15.0 | 2.4 | 10.4 |
| 24 | 0.14/0.18 | 1.2 | 5.9 | 3.1 | 14.3 | 2.3 | 10.1 | 3.5 | | | |
| 25 | 0.16/0.21 | 2.8 | 12.5 | 1.2 | 5.5 | | | | | 2.8 | 12.0 |
| 26 | 0.14/0.18 | 0.1 | 0.7 | 2.4 | 11.6 | | | 3.1 | 13.2 | | |
| 27 | 0.16/0.21 | 1.2 | 5.7 | 1.5 | 7.0 | | | | | | |
| 28 | 0.16/0.21 | 1.0 | 4.9 | 2.5 | 11.0 | | | | | | |
| 29 | 0.14/0.18 | 1.6 | 7.3 | 3.3 | 16.0 | 2.9 | 12.8 | 3.1 | 13.0 | 3.1 | 13.1 |
| 30 | 0.14/0.18 | 2.7 | 13.0 | 2.2 | 10.9 | | | 3.2 | 13.6 | 2.6 | 11.1 |
| 31 | 0.14/0.18 | 2.3 | 11.3 | 1.8 | 7.7 | | | | | | |
| 32 | 0.14/0.18 | 0.9 | 3.8 | 2.1 | 9.0 | | | | | | |
| 33 | 0.14/0.18 | 1.7 | 7.3 | 1.2 | 5.4 | | | | | | |
| 34 | 0.14/0.18 | 1.5 | 6.4 | 2.1 | 10.7 | | | | | | |
| 35 | 0.14/0.18 | 1.6 | 7.9 | 1.1 | 4.6 | | | | | | |
| 36 | 0.14/0.18 | 0.9 | 3.8 | 2.0 | 9.4 | | | | | | |
| 37 | 0.14/0.18 | 2.1 | 10.0 | 2.0 | 9.4 | | | | | | |
| 38 | 0.14/0.18 | 1.9 | 9.0 | 2.6 | 10.7 | | | | | | |
| 15 | 0.14/0.19 | 3.5 | 14.6 | 3.2 | 13.4 | 1.8 | 8.0 | 3.8 | 16.4 | 2.1 | 9.0 |
| 16 | 0.14/0.20 | 3.0 | 12.5 | 2.6 | 10.7 | 1.3 | 6.4 | 2.1 | 10.6 | 2.6 | 12.8 |
| 17 | 0.14/0.21 | 1.5 | 6.4 | | | | | | | | |

| | 60 C pH 10.5 | | 90 C pH 10.5 | | SSWB 60 C pH 10 | |
|---|---|---|---|---|---|---|
| | Δ Brightness | % Chemical savings | Δ Brightness | % Chemical savings | Δ Brightness | % Chemical savings |
| 23 | 0.14/0.18 | 0.4 | 2.0 | 2.2 | 1.6 | 6.9 | 1.8 | 8.7 |

Figure 27A (top)
Figure 27B (bottom)

XYLANASES, NUCLEIC ACIDS ENCODING THEM AND METHODS FOR MAKING AND USING THEM

CROSS-REFERENCE TO RELATED APPLICATIONS

This application is the national phase of PCT application PCT/US2007/004429 having an international filing date of Feb. 14, 2007, which claims benefit of Provisional Application Ser. No. 60/773,122 filed Feb. 14, 2007. The contents of the above patent applications are incorporated by reference herein in their entirety.

REFERENCE TO SEQUENCE LISTING SUBMITTED VIA EFS-WEB

The entire content of the following electronic submission of the sequence listing via the USPTO EFS-WEB server, as authorized and set forth in MPEP §1730 II.B.2(a)(C), is incorporated herein by reference in its entirety for all purposes. The sequence listing is identified on the electronically filed text file as follows:

| File Name | Date of Creation | Size (bytes) |
|---|---|---|
| 564462007930Seqlist.txt | Nov. 11, 2008 | 1,852,466 bytes |

FIELD OF THE INVENTION

This invention relates generally to enzymes, polynucleotides encoding the enzymes, the use of such polynucleotides and polypeptides and more specifically to enzymes having xylanase activity, e.g., catalyzing hydrolysis of internal β-1,4-xylosidic linkages or endo-β-1,4-glucanase linkages; and/or degrading a linear polysaccharide beta-1,4-xylan into xylose; or, a glucanase activity, e.g., an endoglucanase activity, for example, catalyzing hydrolysis of internal endo-β-1,4- and/or 1,3-glucanase linkages, a xylanase activity, and/or a mannanase activity. Thus, the invention provides methods and processes for breaking down hemicellulose, which is a major component of the cell wall of plants, including methods and processes for hydrolyzing hemicelluloses in any organic compound, plant or wood or wood product or byproduct, wood waste, paper pulp, paper product or paper waste or byproduct.

BACKGROUND

Xylanases (e.g., endo-1,4-beta-xylanase, EC 3.2.1.8) hydrolyze internal β-1,4-xylosidic linkages in xylan to produce smaller molecular weight xylose and xylo-oligomers. Xylans are polysaccharides formed from 1,4-β-glycoside-linked D-xylopyranoses. Xylanases are of considerable commercial value, being used in the food industry, for baking and fruit and vegetable processing, breakdown of agricultural waste, in the manufacture of animal feed and in pulp and paper production. Xylanases are formed by fungi and bacteria.

Arabinoxylans are major non-starch polysaccharides of cereals representing 2.5-7.1% w/w depending on variety and growth conditions. The physicochemical properties of this polysaccharide are such that it gives rise to viscous solutions or even gels under oxidative conditions. In addition, arabinoxylans have high water-binding capacity and may have a role in protein foam stability. All of these characteristics present problems for several industries including brewing, baking, animal nutrition and paper manufacturing. In brewing applications, the presence of xylan results in wort filterability and haze formation issues. In baking applications (especially for cookies and crackers), these arabinoxylans create sticky doughs that are difficult to machine and reduce biscuit size. In addition, this carbohydrate is implicated in rapid rehydration of the baked product resulting in loss of crispiness and reduced shelf-life. For monogastric animal feed applications with cereal diets, arabinoxylan is a major contributing factor to viscosity of gut contents and thereby adversely affects the digestibility of the feed and animal growth rate. For ruminant animals, these polysaccharides represent substantial components of fiber intake and more complete digestion of arabinoxylans would facilitate higher feed conversion efficiencies.

Xylanases have been shown to be useful in biobleaching and treatment of chemical pulps (see, for example, U.S. Pat. No. 5,202,249), biobleaching and treatment of wood or paper pulps (see, for example, U.S. Pat. Nos. 5,179,021, 5,116,746, 5,407,827, 5,405,769, 5,395,765, 5,369,024, 5,457,045, 5,434,071, 5,498,534, 5,591,304, 5,645,686, 5,725,732, 5,759,840, 5,834,301, 5,871,730 and 6,057,438) in reducing lignin in wood and modifying wood (see, for example, U.S. Pat. Nos. 5,486,468 and 5,770,012) as flour, dough and bread improvers (see, for example, U.S. Pat. Nos. 5,108,765 and 5,306,633) as feed additives and/or supplements, as set forth above (see, for example, U.S. Pat. Nos. 5,432,074, 5,429,828, 5,612,055, 5,720,971, 5,981,233, 5,948,667, 6,099,844, 6,132,727 and 6,132,716), in manufacturing cellulose solutions (see, for example, U.S. Pat. No. 5,760,211). Detergent compositions having xylanase activity are used for fruit, vegetables and/or mud and clay compounds (see, for example, U.S. Pat. No. 5,786,316). Xylanases may also be used in hydrolysis of hemicellulose for which it is selective, particularly in the presence of cellulose. Additionally, the cellulase rich retentate is suitable for the hydrolysis of cellulose (see, for example, U.S. Pat. No. 4,725,544).

There remains a need in the art for xylanases to be used in the paper and pulp industry, for example, where the enzyme is active in the temperature range of 65° C. to 75° C. and at a pH of approximately 10. Additionally, an enzyme useful in the paper and pulp industry would decrease the need for bleaching chemicals, such as chlorine dioxide.

SUMMARY OF THE INVENTION

The invention provides enzymes having: xylanase activity, e.g., catalyzing hydrolysis of internal β-1,4-xylosidic linkages or endo-β-1,4-glucanase linkages; and/or, having a glucanase activity, e.g., an endoglucanase activity, for example, catalyzing hydrolysis of internal endo-β-1,4- and/or 1,3-glucanase linkages, a xylanase activity, and/or a mannanase activity; and, nucleic acids encoding them, vectors and cells comprising them, probes for amplifying and identifying these xylanase-encoding nucleic acids, and methods for making and using these polypeptides and peptides.

For example, the invention provides enzymes having xylanase activity, and compositions and methods comprising them, for hydrolyzing internal β-1,4-xylosidic linkages or endo-β-1,4-glucanase linkages, or hemicelluloses, in a wood, wood product, paper pulp, paper product or paper waste. In one aspect, the xylanase activity comprises catalyzing hydrolysis of xylan, e.g., degrading a linear polysaccharide beta-1,4-xylan into a xylose. Thus, the invention provides methods and processes for breaking down a xylan-comprising composition and/or a hemicellulose, which is a major component of the cell wall of plants.

In one aspect, the glucanase activity of a polypeptide or peptide of the invention (which includes a protein or peptide encoded by a nucleic acid of the invention) comprises an endoglucanase activity, e.g., endo-1,4- and/or 1,3-beta-D-glucan 4-glucano hydrolase activity. In one aspect, the endoglucanase activity comprises catalyzing hydrolysis of 1,4-beta-D-glycosidic linkages. In one aspect, the glucanase, e.g., endoglucanase, activity comprises an endo-1,4- and/or 1,3-beta-endoglucanase activity or endo-β-1,4-glucanase activity. In one aspect, the glucanase activity (e.g., endo-1,4-beta-D-glucan 4-glucano hydrolase activity) comprises hydrolysis of 1,4-beta-D-glycosidic linkages in cellulose, cellulose derivatives (e.g., carboxy methyl cellulose and hydroxy ethyl cellulose) lichenin, beta-1,4 bonds in mixed beta-1,3 glucans, such as cereal beta-D-glucans and other plant material containing cellulosic parts. In one aspect, the glucanase, xylanase, or mannanase activity comprises hydrolyzing a glucan or other polysaccharide to produce a smaller molecular weight polysaccharide or oligomer. In one aspect, the glucan comprises a beta-glucan, such as a water soluble beta-glucan.

The invention provides enzymes, compositions, methods and processes for hydrolyzing hemicelluloses in any organic matter, including cells, plants and/or wood or wood products, wood waste, paper pulp, paper products or paper waste or byproducts.

In another aspect, the invention provides polypeptides having lignocellulolytic (lignocellulosic) activity, e.g., a lignolytic and cellulolytic activity, including, e.g., having a hydrolase activity, e.g., a glycosyl hydrolase activity, including cellulase, glucanase, xylanase, and/or mannanase activity, and nucleic acids encoding them, and methods for making and using them. The invention provides enzymes for the bioconversion of any biomass, e.g., a lignocellulosic residue, into fermentable sugars or polysaccharides; and these sugars or polysaccharides can be used as a chemical feedstock for the production of alcohols such as ethanol, propanol, butanol and/or methanol, and in the production of fuels, e.g., biofuels such as synthetic liquids or gases, such as syngas.

In one aspect, the enzymes of the invention have an increased catalytic rate to improve the process of substrate (e.g., a lignocellulosic residue, cellulose, bagasse) hydrolysis. This increased efficiency in catalytic rate leads to an increased efficiency in producing sugars or polysaccharides, which can be useful in industrial, agricultural or medical applications, e.g., to make a biofuel or an alcohol such as ethanol, propanol, butanol and/or methanol. In one aspect, sugars produced by hydrolysis using enzymes of this invention can be used by microorganisms for alcohol (e.g., ethanol, propanol, butanol and/or methanol) production and/or fuel (e.g., biofuel) production.

The invention provides industrial, agricultural or medical applications: e.g., biomass to biofuel, e.g., ethanol, propanol, butanol and/or methanol, using enzymes of the invention having decreased enzyme costs, e.g., decreased costs in biomass to biofuel conversion processes. Thus, the invention provides efficient processes for producing bioalcohols, biofuels and/or biofuel—(e.g., bioethanol-, propanol-, butanol- and/or methanol-) comprising compositions, including synthetic, liquid or gas fuels comprising a bioalcohol, from any biomass.

In one aspect, enzymes of the invention, including the enzyme "cocktails" of the invention ("cocktails" meaning mixtures of enzymes comprising at least one enzyme of this invention), are used to hydrolyze the major components of a lignocellulosic biomass, or any composition comprising cellulose and/or hemicellulose (lignocellulosic biomass also comprises lignin), e.g., seeds, grains, tubers, plant waste (such as a hay or straw, e.g., a rice straw or a wheat straw, or any the dry stalk of any cereal plant) or byproducts of food processing or industrial processing (e.g., stalks), corn (including cobs, stover, and the like), grasses (e.g., Indian grass, such as *Sorghastrum mutans*; or, switch grass, e.g., *Panicum* species, such as *Panicum virgatum*), wood (including wood chips, processing waste, such as wood waste), paper, pulp, recycled paper (e.g., newspaper); also including a monocot or a dicot, or a monocot corn, sugarcane or parts thereof (e.g., cane tops), rice, wheat, barley, switchgrass or *Miscanthus*; or a dicot oilseed crop, soy, canola, rapeseed, flax, cotton, palm oil, sugar beet, peanut, tree, poplar or lupine; or, woods or wood processing byproducts, such as wood waste, e.g., in the wood processing, pulp and/or paper industry, in textile manufacture and in household and industrial cleaning agents, and/or in biomass waste processing.

In one aspect, enzymes of the invention are used to hydrolyze cellulose comprising a linear chain of β-1,4-linked glucose moieties, and/or hemicellulose as a complex structure that varies from plant to plant. In one aspect, enzymes of the invention are used to hydrolyze hemicelluloses containing a backbone of β-1,4 linked xylose molecules with intermittent branches of arabinose, galactose, glucuronic acid and/or mannose. In one aspect, enzymes of the invention are used to hydrolyze hemicellulose containing non-carbohydrate constituents such as acetyl groups on xylose and ferulic acid esters on arabinose. In one aspect, enzymes of the invention are used to hydrolyze hemicelluloses covalently linked to lignin and/or coupled to other hemicellulose strands via diferulate crosslinks.

In one aspect, the compositions and methods of the invention are used in the enzymatic digestion of biomass and can comprise use of many different enzymes, including the cellulases and hemicellulases. Lignocellulosic enzymes used to practice the invention can digest cellulose to monomeric sugars, including glucose. In one aspect, compositions used to practice the invention can include mixtures of enzymes, e.g., glycosyl hydrolases, glucose oxidases, xylanases, xylosidases (e.g., β-xylosidases), cellobiohydrolases, and/or arabinofuranosidases or other enzymes that can digest hemicellulose to monomer sugars. Mixtures of the invention can comprise, or consist of, only enzymes of this invention, or can include at least one enzyme of this invention and another enzyme, which can also be a lignocellulosic enzyme and/or any other enzyme.

In one aspect, the enzymes of the invention have a glucanase, e.g., an endoglucanase, activity, e.g., catalyzing hydrolysis of internal endo-β-1,4- and/or β-1,3-glucanase linkages. In one aspect, the endoglucanase activity (e.g., endo-1,4-beta-D-glucan 4-glucano hydrolase activity) comprises hydrolysis of 1,4- and/or β-1,3-beta-D-glycosidic linkages in cellulose, cellulose derivatives (e.g., carboxy methyl cellulose and hydroxy ethyl cellulose) lichenin, beta-1,4 bonds in mixed beta-1,3 glucans, such as cereal beta-D-glucans or xyloglucans and other plant material containing cellulosic parts.

In alternative embodiments, the invention provides polypeptides (and the nucleic acids that encode them) having at least one conservative amino acid substitution and retaining its xylanase, a mannanase and/or a glucanase activity; or, wherein the at least one conservative amino acid substitution comprises substituting an amino acid with another amino acid of like characteristics; or, a conservative substitution comprises: replacement of an aliphatic amino acid with another aliphatic amino acid; replacement of a Serine with a Threonine or vice versa; replacement of an acidic residue with another acidic residue; replacement of a residue bearing an amide group with another residue bearing an amide group; exchange of a basic residue with another basic residue; or replacement of an aromatic residue with another aromatic residue;

In alternative embodiments, the invention provides polypeptides (and the nucleic acids that encode them) having a xylanase, a mannanase and/or a glucanase activity but lacking a signal sequence, a prepro domain, a dockerin domain, and/or a carbohydrate binding module (CBM); and in one aspect, the carbohydrate binding module (CBM) comprises, or consists of, a xylan binding module, a cellulose binding module, a lignin binding module, a xylose binding module, a mannanse binding module, a xyloglucan-specific module and/or a arabinofuranosidase binding module.

In alternative embodiments, the invention provides polypeptides (and the nucleic acids that encode them) having a xylanase, a mannanase and/or a glucanase activity further comprising a heterologous sequence; and in one aspect, the heterologous sequence comprises, or consists of a sequence encoding: (i) a heterologous signal sequence, a heterologous carbohydrate binding module, a heterologous dockerin domain, a heterologous catalytic domain (CD), or a combination thereof, (ii) the sequence of (ii), wherein the heterologous signal sequence, carbohydrate binding module or catalytic domain (CD) is derived from a heterologous enzyme; or, (iii) a tag, an epitope, a targeting peptide, a cleavable sequence, a detectable moiety or an enzyme; and in one aspect, the heterologous carbohydrate binding module (CBM) comprises, or consists of, a xylan binding module, a cellulose binding module, a lignin binding module, a xylose binding module, a mannanse binding module, a xyloglucan-specific module and/or a arabinofuranosidase binding module; and in one aspect, the heterologous signal sequence targets the encoded protein to a vacuole, the endoplasmic reticulum, a chloroplast or a starch granule.

The invention provides isolated, synthetic or recombinant nucleic acids comprising a nucleic acid encoding at least one polypeptide having a xylanase, a mannanase and/or a glucanase activity, wherein the nucleic acid comprises a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to an exemplary nucleic acid of the invention, including the sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:11, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:199, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521, SEQ ID NO:523, SEQ ID NO:525, SEQ ID NO:527, SEQ ID NO:529, SEQ ID NO:531, SEQ ID NO:533, SEQ ID NO:535, SEQ ID NO:537, SEQ ID NO:539, SEQ ID NO:541, SEQ ID NO:543, SEQ ID NO:545, SEQ ID NO:547, SEQ ID NO:549, SEQ ID NO:551, SEQ ID NO:553, SEQ ID NO:555, SEQ ID NO:557, SEQ ID NO:559, SEQ ID NO:561, SEQ ID NO:563, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:589, SEQ ID NO:591, SEQ ID NO:593, SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619, SEQ ID NO:621, SEQ ID NO:623, SEQ ID NO:625, SEQ ID NO:627, SEQ ID NO:629, SEQ ID NO:631, SEQ ID NO:633 and/or SEQ ID NO:635 (or, hereinafter referred to as: the odd SEQ ID NOs. between SEQ ID NO:1 and SEQ ID NO:635, or, the exemplary nucleic acid sequences of the invention), over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues, or the full length of a cDNA, transcript (mRNA) or gene, wherein the nucleic acid encodes at least one polypeptide having a xylanase, a mannanase and/or a glucanase activity, or encodes a protein that can generate an antibody specific for a polypeptide of this invention, such as epitopes or immunogens (hereinafter collectively referred to as nucleic acids of the invention), or over a region consisting of the protein coding region (e.g., the cDNA) or the genomic sequence; and all of these nucleic acid sequences, and the polypeptides they encode, encompass "sequences of the invention". In one aspect (optionally) the sequence identities are determined by analysis with a sequence comparison algorithm or by a visual inspection, and in one aspect (optionally) the sequence comparison algorithm is a BLAST version 2.2.2 algorithm where a filtering setting is set to blastall -p blastp -d "nr pataa"-F F, and all other options are set to default.

The invention provides isolated, synthetic or recombinant nucleic acids comprising a nucleic acid encoding at least one polypeptide having a xylanase, a mannanase and/or a glucanase activity, wherein the nucleic acid comprises a sequence that hybridizes under stringent conditions to a nucleic acid comprising an exemplary nucleic acid sequence of the invention (i.e., sequences as set forth in SEQ ID NO:1, SEQ ID NO:3, SEQ ID NO:5, etc., including all the odd SEQ ID NOs. between SEQ ID NO:1 and SEQ ID NO:635), and in one aspect (optionally) the stringent conditions comprise a wash step comprising a wash in 0.2×SSC at a temperature of about 65° C. for about 15 minutes, and in one aspect (optionally) the nucleic acid is at least about 25, 50, 75, 100, 125, 150, 175, 200, 225, 300, 350, 400, 450, 500, 600, 700, 800, 900, 1000 or more residues in length or the full length of the gene or transcript.

The invention provides isolated, synthetic or recombinant nucleic acids comprising a nucleic acid encoding at least one polypeptide having a xylanase, a mannanase and/or a glucanase activity, wherein the polypeptide has a sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ ID NO:134; SEQ ID NO:136; SEQ ID NO:138; SEQ ID NO:140; SEQ ID NO:142; SEQ ID NO:144; NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634 and/or SEQ ID NO:636, or enzymatically active fragments thereof, including the sequences described in Tables 1 to 4, and the Sequence Listing (all of these sequences are "exemplary enzymes/polypeptides of the invention"), and enzymatically active subsequences (fragments) thereof and/or immunologically active subsequences thereof (such as epitopes or immunogens) (all "peptides of the invention") and variants thereof (all of these sequences encompassing polypeptide and peptide sequences of the invention) (or, hereinafter referred to as: the even SEQ ID NOs. between SEQ ID NO:2 and SEQ ID NO:636; or, the exemplary polypeptide sequences of the inventions).

The invention provides isolated, synthetic or recombinant nucleic acids comprising sequences completely complementary to all of these nucleic acid sequences of the invention (complementary (non-coding) and coding sequences also hereinafter collectively referred to as nucleic acid sequences of the invention).

In one aspect, the sequence identity is at least about 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% (complete) sequence identity (homology). In one aspect, the sequence identity is over a region of at least about 150, 175, 200, 225, 250, 275, 300, 350, 400, 450, 500, 550, 600, 650, 700, 750, 800, 850, 900, 950, 1000, 1050, 1100, 1150 or more residues, or the full length of a gene or a transcript. For example, the invention provides isolated, synthetic or recombinant nucleic acids comprising a nucleic acid sequence as set forth in any of the odd SEQ ID NOs. between SEQ ID NO:1 and SEQ ID NO: 635 (the exemplary polynucleotide sequences of this invention). The invention provides isolated, synthetic or recombinant nucleic acids encoding a polypeptide comprising a sequence as set forth in any of the even SEQ ID NOs. between SEQ ID NO:2 and SEQ ID NO:636 (the exemplary polypeptide sequences of this invention), and enzymatically active fragments thereof.

The invention provides isolated, synthetic or recombinant nucleic acids encoding a polypeptide having xylanase, a mannanase and/or a glucanase activity, wherein the nucleic acid has at least one sequence modification of an exemplary sequence of the invention, or, any sequence of the invention.

The invention provides isolated, synthetic or recombinant nucleic acids encoding a polypeptide having xylanase, a mannanase and/or a glucanase activity, wherein the nucleic acid has at least one sequence modification of an exemplary nucleic acid of the invention, wherein the sequence modification comprises at least one, two, three, four, five, six, seven, eight, nine, ten, eleven, twelve, thirteen, fourteen, fifteen, sixteen, seventeen, eighteen, nineteen or all of the following changes: the nucleotides at the equivalent of residues 10 to 12 of SEQ ID NO:383 are changed to CCT, TTA, TTG, CTC, CTA or CTG, the nucleotides at the equivalent of residues 25 to 27 of SEQ ID NO:383 are changed to CCC, CCG, CCA or CCT, the nucleotides at the equivalent of residues 28 to 30 of SEQ ID NO:383 are changed to TCA, TCC, TCT, TCG, AGT or AGC, the nucleotides at the equivalent of residues 37 to 39 of SEQ ID NO:383 are changed to TTT or TTC, the nucleotides at the equivalent of residues 37 to 39 of SEQ ID NO:383 are changed to TAC or TAT, the nucleotides at the equivalent of residues 37 to 39 of SEQ ID NO:383 are changed to ATA, ATT or ATC, the nucleotides at the equivalent of residues 37 to 39 of SEQ ID NO:383 are changed to TGG, the nucleotides at the equivalent of residues 40 to 42 of SEQ ID NO:383 are changed to CAC or CAT, the nucleotides at the equivalent of residues 52 to 54 of SEQ ID NO:383 are changed to TTC or TTT, the nucleotides at the equivalent of residues 73 to 75 of SEQ ID NO:383 are changed to GAG or GAA, the nucleotides at the equivalent of residues 73 to 75 of SEQ ID NO:383 are changed to CCC, CCG, CCA or CCT, the nucleotides at the equivalent of residues 88 to 90 of SEQ ID NO:383 are changed to GTG, GTC, GTA or GTT, the nucleotides at the equivalent of residues 100 to 102 of SEQ ID NO:383 are changed to TGT or TGC, the nucleotides at the equivalent of residues 100 to 102 of SEQ ID NO:383 are changed to CAT or CAC, the nucleotides at the equivalent of residues 100 to 102 of SEQ ID NO:383 are changed to TTG, TTA, CTT, CTC, CTA or CTG, the nucleotides at the equivalent of residues 103 to 105 of SEQ ID NO:383 are changed to GAG or GAA, the nucleotides at the equivalent of residues 103 to 105 of SEQ ID NO:383 are changed to GAT or GAC, the nucleotides at the equivalent of residues 211 to 213 of SEQ ID NO:383 are changed to ACA, ACT, ACC or ACG, the nucleotides at the equivalent of residues 211 to 213 of SEQ ID NO:383 are changed to TGT or TGC, or the nucleotides at the equivalent of residues 508 to 582 of SEQ ID NO:383 are changed to CAT or CAC.

The invention provides isolated, synthetic or recombinant nucleic acids encoding a polypeptide having xylanase, a mannanase and/or a glucanase activity, wherein the nucleic acid has at least one sequence modification of SEQ ID NO:383, or the equivalent of at least one sequence modification of SEQ ID NO:383, and the at least one modification of SEQ ID NO:383 comprises a change in: the nucleotides at residues 10 to 12 are CCT, TTA, TTG, CTC, CTA or CTG, the nucleotides at residues 25 to 27 are CCC, CCG, CCA or CCT, the nucleotides at residues 28 to 30 are TCA, TCC, TCT, TCG, AGT or AGC, the nucleotides at residues 37 to 39 are TTT or TTC, the nucleotides at residues 37 to 39 are TAC or TAT, the nucleotides at residues 37 to 39 are ATA, ATT or ATC, the nucleotides at residues 37 to 39 are TGG, the nucleotides at residues 40 to 42 are CAC or CAT, the nucleotides at residues 52 to 54 are TTC or TTT, the nucleotides at residues 73 to 75 are GAG or GAA, the nucleotides at residues 73 to 75 are CCC, CCG, CCA or CCT, the nucleotides at residues 88 to 90 are GTG, GTC, GTA or GTT, the nucleotides at residues 100 to 102 are TGT or TGC, the nucleotides at residues 100 to 102 are CAT or CAC, the nucleotides at residues 100 to 102 are TTG, TTA, CTT, CTC, CTA or CTG, the nucleotides at residues 103 to 105 are GAG or GAA, the nucleotides at residues 103 to 105 are GAT or GAC, the nucleotides at residues 211 to 213 are ACA, ACT, ACC or ACG, the nucleotides at residues 211 to 213 are TGT or TGC, or the nucleotides at residues 508 to 582 are CAT or CAC. In alternative aspects, the sequence modification comprises at least two of the changes, at least three of the changes, at least four of the changes, or at least five, six, seven, eight, nine, ten, eleven, twelve, thirteen, fourteen, fifteen, sixteen, seventeen, eighteen, nineteen or all of the changes.

In one aspect, the invention also provides enzyme-encoding nucleic acids with a common novelty in that they encode a novel subset of xylanases, or a clade, comprising the "X14 module" (J. Bacteriol. 2002 August; 184(15): 4124-4133). In one aspect, the invention also provides enzyme-encoding nucleic acids with a common novelty in that they encode a novel subset of xylanases, or a clade, comprising the "X14 module". X14-comprising xylanase members of this clade are listed in Table 9, below. Thus, in one aspect, the invention provides a novel genus of xylanases comprising xylanase members of the clade listed in Table 9, below, and related enzymes (e.g., xylanases having a sequence identity to an exemplary enzyme of the invention as listed in Table 9, below).

In one aspect (optionally), the isolated, synthetic or recombinant nucleic acids of the invention have a xylanase, a mannanase and/or a glucanase activity, e.g., wherein the xylanase activity comprises catalyzing hydrolysis of internal β-1,4-xylosidic linkages; comprises an endo-1,4-beta-.xylanase activity; comprises hydrolyzing a xylan or an arabinoxylan to produce a smaller molecular weight xylose and xylo-oligomer; comprises hydrolyzing a polysaccharide comprising a 1,4-β-glycoside-linked D-xylopyranose; comprises hydrolyzing a cellulose or a hemicellulose; comprises hydrolyzing a cellulose or a hemicellulose in a wood, wood product, paper pulp, paper product or paper waste; comprises catalyzing hydrolysis of a xylan or an arabinoxylan in a feed or a food product; or, comprises catalyzing hydrolysis of a xylan or an arabinoxylan in a microbial cell or a plant cell. In one aspect, the xylanase activity comprises hydrolyzing polysaccharides comprising 1,4-β-glycoside-linked D-xylopyranoses or hydrolyzing hemicelluloses, e.g., hydrolyzing hemicelluloses in a wood, wood product, paper pulp, paper product or paper waste. In one aspect, the arabinoxylan is a cereal arabinoxylan, such as a wheat arabinoxylan.

In one aspect, the xylanase, a mannanase and/or a glucanase activity comprises catalyzing hydrolysis of polysaccarides, e.g., mannans or xylans, in a feed or a food product, such as a cereal-based animal feed, a wort or a beer, a milk or a milk product, a fruit or a vegetable. In one aspect, the xylanase, a mannanase and/or a glucanase activity comprises catalyzing hydrolysis of polysaccarides, e.g., mannans or xylans, in a microbial cell or a plant cell.

In one aspect, the xylanase, a mannanase and/or a glucanase activity is thermostable, e.g., wherein the polypeptide retains a xylanase, a mannanase and/or a glucanase activity under conditions comprising a temperature range of between about 1° C. to about 5° C., between about 5° C. to about 15° C., between about 15° C. to about 25° C., between about 25° C. to about 37° C., 37° C. to about 95° C., or between about 55° C. to about 85° C., or between about 70° C. to about 75° C., or between about 70° C. to about 95° C., between about 90° C. to about 95° C., between about 95° C. to about 105° C., or between about 95° C. to about 110° C. In one aspect, wherein the polypeptide retains a xylanase, a mannanase and/or a glucanase activity under conditions comprising a temperature range of between about 1° C. to about 5° C., between about 5° C. to about 15° C., between about 15° C. to about 25° C., between about 25° C. to about 37° C. In one aspect polypeptides of the invention retain activity at temperatures up to 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more; in another aspect, the polypeptides of the invention retain activity after exposure to temperatures up to 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more.

In one aspect, the xylanase, a mannanase and/or a glucanase activity is thermotolerant, e.g., wherein the polypeptide retains a xylanase, a mannanase and/or a glucanase activity after exposure to a temperature in the range from greater than 37° C. to about 95° C., or between about 55° C. to about 85° C., or between about 70° C. to about 75° C., or between about 70° C. to about 95° C., between about 90° C. to about 95° C., between about 95° C. to about 105° C., or between about 95° C. to about 110° C. In one aspect, wherein the polypeptide retains a xylanase, a mannanase and/or a glucanase activity after exposure to conditions comprising a temperature range of between about 1° C. to about 5° C., between about 5° C. to about 15° C., between about 15° C. to about 25° C., between about 25° C. to about 37° C. In one aspect polypeptides of the invention can retain a xylanase, a mannanase and/or a glucanase activity after exposure to a temperature up to 90° C., 91° C., 92° C., 93° C., 94° C., 95° C., 96° C., 97° C., 98° C., 99° C., 1000° C., 101° C., 102° C., 103° C., 103.5° C., 104° C., 105° C., 107° C., 108° C., 109° C. or 110° C., or more.

In one aspect, the xylanase, a mannanase and/or a glucanase activity of polypeptides encoded by nucleic acids of the invention retain activity under acidic conditions comprising about pH 6.5, pH 6, pH 5.5, pH 5, pH 4.5 or pH 4 or less (more acidic), or, retain a xylanase, a mannanase and/or a glucanase activity after exposure to acidic conditions comprising about pH 6.5, pH 6, pH 5.5, pH 5, pH 4.5 or pH 4 or less (more acidic); or, retain activity under basic conditions comprising about pH 7, pH 7.5 pH 8.0, pH 8.5, pH 9, pH 9.5, pH 10, pH 10.5, pH 1, pH 11.5, pH 12, pH 12.5 or more (more basic) or, retain a xylanase, a mannanase and/or a glucanase activity after exposure to basic conditions comprising about pH 7, pH 7.5 pH 8.0, pH 8.5, pH 9, pH 9.5, pH 10, pH 10.5, pH 11, pH 11.5, pH 12, pH 12.5 or more (more basic). In one aspect, xylanase, a mannanase and/or a glucanase activity of polypeptides encoded by nucleic acids of the invention retain activity at a temperature of at least about 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 7.5 pH 8.0, pH 8.5, pH 9, pH 9.5, pH 10, pH 10.5, pH 11, pH 11.5, pH 12, pH 12.5 or more (more basic).

The invention provides expression cassettes, cloning vehicles, or a vector (e.g., expression vectors) comprising a nucleic acid comprising a sequence of the invention. The cloning vehicle can comprise a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise an artificial chromosome comprising a bacterial artificial chromosome (BAC), a bacteriophage P1-derived vector (PAC), a yeast artificial chromosome (YAC), or a mammalian artificial chromosome (MAC).

The invention provides nucleic acid probes for identifying a nucleic acid encoding a polypeptide with a xylanase, a mannanase and/or a glucanase activity, wherein the probe comprises at least about 10, 15, 20, 25, 30, 35, 40, 45, 50, 55, 60, 65, 70, 75, 100, 125, 150, 175, 200, 225, 250, 275, 300 or more consecutive bases of a nucleic acid comprising an exemplary sequence of the invention, or, any sequence of the invention (as defined herein), wherein in one aspect (optionally) the probe comprises an oligonucleotide comprising between at least about 10 to 300, about 25 to 250, about 10 to 50, about 20 to 60, about 30 to 70, about 40 to 80, about 60 to 100, or about 50 to 150 or more consecutive bases.

The invention provides amplification primer pairs for amplifying a nucleic acid encoding a polypeptide having a xylanase, a mannanase and/or a glucanase activity, wherein the primer pair is capable of amplifying a nucleic acid comprising an exemplary sequence of the invention, or, any sequence of the invention (as defined herein), or a subsequence thereof, wherein optionally a member of the amplification primer sequence pair comprises an oligonucleotide comprising at least about 10 to 50 consecutive bases of the sequence, or, about 10, 11, 12, 13, 14, 15, 16, 17, 18, 19, 20, 21, 22, 23, 24, 25, 26, 27, 28, 29, 30, 31, 32, 33, 34, 35 or more consecutive bases of the sequence. The invention provides amplification primer pairs wherein the primer pair comprises a first member having a sequence as set forth by about the first (the 5') 10, 11, 12, 13, 14, 15, 16, 17, 18, 19, 20, 21, 22, 23, 24, 25, 26, 27, 28, 29, 30, 31, 32, 33, 34, 35 or more residues of an exemplary sequence of the invention, or, any sequence of the invention (as defined herein), and a second member having a sequence as set forth by about the first (the 5') 10, 11, 12, 13, 14, 15, 16, 17, 18, 19, 20, 21, 22, 23, 24, 25, 26, 27, 28, 29, 30, 31, 32, 33, 34, 35 or more residues of the complementary strand of the first member.

The invention provides xylanase- and/or a glucanase-encoding nucleic acids generated by amplification of a polynucleotide using an amplification primer pair of the invention, wherein optionally the amplification is by polymerase chain reaction (PCR). In one aspect, the nucleic acid is generated by amplification of a gene library, wherein in one aspect (optionally) the gene library is an environmental library. The invention provides isolated, synthetic or recombinant xylanases and/or a glucanases encoded by a xylanase- and/or a glucanase-encoding nucleic acid generated by amplification of a polynucleotide using an amplification primer pair of the invention. The invention provides methods of amplifying a nucleic acid encoding a polypeptide having a xylanase, a mannanase and/or a glucanase activity, the methods comprising the step of amplification of a template nucleic acid with an amplification primer sequence pair capable of amplifying an exemplary sequence of the invention, or, any sequence of the invention (as defined herein), or a subsequence thereof.

The invention provides expression cassette, a vector or a cloning vehicle comprising a nucleic acid comprising a sequence of the invention, wherein optionally the cloning vehicle comprises a viral vector, a plasmid, a phage, a phagemid, a cosmid, a fosmid, a bacteriophage or an artificial chromosome. The viral vector can comprise an adenovirus vector, a retroviral vector or an adeno-associated viral vector, or, the artificial chromosome comprises a bacterial artificial chromosome (BAC), a bacteriophage P1-derived vector (PAC), a yeast artificial chromosome (YAC), or a mammalian artificial chromosome (MAC).

The invention provides transformed cells comprising a nucleic acid or vector of the invention, or an expression cassette or cloning vehicle of the invention. The transformed cell can be a bacterial cell, a mammalian cell, a fungal cell, a yeast cell, an insect cell or a plant cell.

The invention provides transgenic non-human animals comprising a sequence of the invention. The transgenic non-human animal can be a mouse, a rat, a rabbit, a sheep, a pig, a chicken, a goat, a fish, a dog, or a cow. The invention provides transgenic plants comprising a sequence of the invention, e.g., wherein the plant is a corn plant, a sorghum plant, a potato plant, a tomato plant, a wheat plant, an oilseed plant, a rapeseed plant, a soybean plant, a rice plant, a barley plant, a grass, or a tobacco plant. The invention provides transgenic seeds comprising a sequence of the invention, e.g., wherein the seed is a corn seed, a wheat kernel, an oilseed, a rapeseed, a soybean seed, a palm kernel, a sunflower seed, a sesame seed, a rice, a barley, a peanut or a tobacco plant seed.

The invention provides antisense oligonucleotides comprising a nucleic acid sequence complementary to or capable of hybridizing under stringent conditions to a sequence of the invention (including, e.g., exemplary sequences of the invention), or a subsequence thereof, wherein optionally the antisense oligonucleotide is between about 10 to 50, about 20 to 60, about 30 to 70, about 40 to 80, or about 60 to 100 bases in length, and in one aspect (optionally) the stringent conditions comprise a wash step comprising a wash in 0.2×SSC at a temperature of about 65° C. for about 15 minutes.

The invention provides methods of inhibiting the translation of a xylanase, a mannanase and/or a glucanase message in a cell comprising administering to the cell or expressing in the cell an antisense oligonucleotide comprising a nucleic acid sequence complementary to or capable of hybridizing under stringent conditions to a sequence of the invention (including, e.g., exemplary sequences of the invention).

The invention provides double-stranded inhibitory RNA (RNAi) molecules comprising a subsequence of a sequence of the invention (including, e.g., exemplary sequences of the invention). The double-stranded inhibitory RNA (RNAi) molecule can be about 10, 11, 12, 13, 14, 15, 16, 17, 18, 19, 20, 21, 22, 23, 24, 25, 26, 27, 28, 29, or 30 or more duplex nucleotides in length. The invention provides methods of inhibiting the expression of a xylanase, a mannanase and/or a glucanase in a cell comprising administering to the cell or expressing in the cell a double-stranded inhibitory RNA (iRNA), wherein the RNA comprises a subsequence of a sequence of the invention (including, e.g., exemplary sequences of the invention).

The invention provides isolated, synthetic or recombinant polypeptides having a xylanase, a mannanase and/or a glucanase activity, or polypeptides capable of generating an immune response specific for a xylanase, a mannanase and/or a glucanase (e.g., an epitope), (i) comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or has 100% (complete) sequence identity to an exemplary amino acid sequence of the invention (e.g., SEQ ID NO:2, SEQ ID NO:4, SEQ ID NO:6, SEQ ID NO:8, SEQ ID NO:10, SEQ ID NO:12, . . . SEQ ID NO:636, etc., as described herein), over a region of at least about 10, 15, 20, 25, 30, 35, 40, 45, 50, 60, 70, 75, 100, 125, 150, 175, 200, 225 or 250 or more residues, wherein in one aspect (optionally) the sequence identities are determined by analysis with a sequence comparison algorithm or by a visual inspection, or, (ii) comprising an amino acid sequence encoded by a nucleic acid sequence of the invention (including, e.g., exemplary sequences of the invention). Polypeptide or peptide sequences of the invention include polypeptides or peptides specifically bound by an antibody of the invention (e.g., epitopes), or polypeptides or peptides that can generate an antibody of the invention (e.g., an immunogen).

The invention provides isolated, synthetic or recombinant polypeptides comprising a sequence as set forth in any of the even sequences between SEQ ID NO:2 and SEQ ID NO:636 (the exemplary polypeptide sequence of the invention), and enzymatically active fragments thereof, and variants thereof, for example: in alternative embodiments, variant xylanase, a mannanase and/or a glucanase enzymes of the invention comprise the sequences of: SEQ ID NO:384 (three amino acid residues were then removed from the carboxy terminal end of the polypeptide SEQ ID NO:382, resulting in SEQ ID NO:384) and SEQ ID NO:482 (see below). The invention provides isolated, synthetic or recombinant polypeptides having xylanase, a mannanase and/or a glucanase activity, wherein the polypeptide has a sequence comprising a sequence modification of an exemplary sequence of the invention (e.g., SEQ ID NO:2, SEQ ID NO:4, SEQ ID NO:6, SEQ ID NO:8, SEQ ID NO:10, SEQ ID NO:12, . . . SEQ ID NO:636, etc., as described herein), wherein the sequence modification comprises at least one, two, three, four, five, six, seven, eight, nine, ten, eleven, twelve, thirteen, fourteen, fifteen, sixteen, seventeen, eighteen, nineteen or all of the following changes: the amino acid at the equivalent of the threonine at residue 4 of SEQ ID NO:384 is leucine, the amino acid at the equivalent of the serine at residue 9 of SEQ ID NO:384 is proline, the amino acid at the equivalent of the glutamine at residue 10 of SEQ ID NO:384 is serine, the amino acid at the equivalent of the threonine at residue 13 of SEQ ID NO:384 is phenylalanine, the amino acid at the equivalent of the threonine at residue 13 of SEQ ID NO:384 is tyrosine, the amino acid at the equivalent of the threonine at residue 13 of SEQ ID NO:384 is isoleucine, the amino acid at the equivalent of the threonine at residue 13 of SEQ ID NO:384 is tryptophan, the amino acid at the equivalent of the asparagine at residue 14 of SEQ ID NO:384 is histidine, the amino acid at the equivalent of the tyrosine at residue 18 of SEQ ID NO:384 is phenylalanine, the amino acid at the equivalent of the serine at residue 25 of SEQ ID NO:384 is glutamic acid, the amino acid at the equivalent of the serine at residue 25 of SEQ ID NO:384 is proline, the amino acid at the equivalent of the asparagine at residue 30 of SEQ ID NO:384 is valine, the amino acid at the equivalent of the glutamine at residue 34 of SEQ ID NO:384 is cysteine, the amino acid at the equivalent of the glutamine at residue 34 of SEQ ID NO:384 is histidine, the amino acid at the equivalent of the glutamine at residue 34 of SEQ ID NO:384 is leucine, the amino acid at the equivalent of the serine at residue 35 of SEQ ID NO:384 is glutamic acid, the amino acid at the equivalent of the serine at residue 35 of SEQ ID NO:384 is aspartic acid, the amino acid at the equivalent of the serine at residue 71 of SEQ ID NO:384 is threonine, the amino acid at the equivalent of the serine at residue 71 of SEQ ID NO:384 is cysteine, or the amino acid at the equivalent of the serine at residue 194 of SEQ ID NO:384 is histidine.

The invention provides isolated, synthetic or recombinant polypeptides having xylanase, a mannanase and/or a glucanase activity, wherein the polypeptide has a sequence comprising one or more of the following changes to the amino acid sequence of SEQ ID NO:384: the threonine at amino acid position 4 is leucine, the serine at amino acid position 9 is proline, the glutamine at amino acid position 10 is serine, the threonine at amino acid position 13 is phenylalanine, the threonine at amino acid position 13 is tyrosine, the threonine at amino acid position 13 is isoleucine, the threonine at amino acid position 13 is tryptophan, the asparagine at amino acid position 14 is histidine, the tyrosine at amino acid position 18 is phenylalanine, the serine at amino acid position 25 is glutamic acid, the serine at amino acid position 25 is proline, the asparagine at amino acid position 30 is valine, the glutamine at amino acid position 34 is cysteine, the glutamine at amino acid position 34 is histidine, the glutamine at amino acid position 34 is leucine, the serine at amino acid position 35 is glutamic acid, the serine at amino acid position 35 is aspartic acid, the serine at amino acid position 71 is threonine, the serine at amino acid position 71 is cysteine, or the serine at amino acid position 194 is histidine. In alternative aspects, the sequence change comprises at least two of the changes, at least three of the changes, at least four of the changes, or the sequence change comprises at least five, six, seven, eight, nine, ten, eleven, twelve, thirteen, fourteen, fifteen, sixteen, seventeen, eighteen, nineteen or all of the changes.

In one aspect, the isolated, synthetic or recombinant peptides of the invention have a xylanase activity, e.g., wherein the xylanase activity comprises catalyzing hydrolysis of internal β-1,4-xylosidic linkages; comprises an endo-1,4-beta-xylanase activity; comprises hydrolyzing a xylan or an arabinoxylan to produce a smaller molecular weight xylose and xylo-oligomer; comprises hydrolyzing a polysaccharide comprising a 1,4-β-glycoside-linked D-xylopyranose; comprises hydrolyzing a cellulose or a hemicellulose; comprises hydrolyzing a cellulose or a hemicellulose in a wood, wood product, paper pulp, paper product or paper waste; comprises catalyzing hydrolysis of a xylan or an arabinoxylan in a feed or a food product; or, comprises catalyzing hydrolysis of a xylan or an arabinoxylan in a microbial cell or a plant cell. The xylan can comprises an arabinoxylan, e.g., a water soluble arabinoxylan, e.g., a water soluble arabinoxylan in a dough or a bread product.

In one aspect, the xylanase, a mannanase and/or a glucanase activity comprises hydrolyzing polysaccharides, for example, comprising 1,4-β-glycoside-linked D-xylopyranoses, or hydrolyzing hemicelluloses, e.g., hydrolyzing hemicelluloses in a wood, wood product, paper pulp, paper product or paper waste.

In one aspect, the xylanase, a mannanase and/or a glucanase activity comprises catalyzing hydrolysis of polysaccharides, e.g., xylans, in a feed or a food product, such as a cereal-based animal feed, a wort or a beer, a milk or a milk product, a fruit or a vegetable. In one aspect, the xylanase activity comprises catalyzing hydrolysis of xylans in a microbial cell or a plant cell.

In one aspect, the xylanase, a mannanase and/or a glucanase activity is thermostable, e.g., wherein the polypeptide retains a xylanase, a mannanase and/or a glucanase activity under conditions comprising a temperature range of between about 37° C. to about 95° C., or between about 55° C. to about 85° C., or between about 70° C. to about 75° C., or between about 70° C. to about 95° C., between about 90° C. to about 95° C., between about 95° C. to about 105° C., or between about 95° C. to about 110° C. In one aspect, wherein the polypeptide retains a xylanase, a mannanase and/or a glucanase activity under conditions comprising a temperature range of between about 1° C. to about 5° C., between about 5°

C. to about 15° C., between about 15° C. to about 25° C., between about 25° C. to about 37° C. In one aspect polypeptides of the invention retain a xylanase, a mannanase and/or a glucanase activity at a temperature up to about 100° C., 101° C., 102° C., 103° C., 103.5° C., 104° C., 105° C., 107° C., 108° C., 109° C. or 110° C.

In one aspect, the xylanase, a mannanase and/or a glucanase activity is thermotolerant, e.g., wherein the polypeptide retains a xylanase, a mannanase and/or a glucanase activity after exposure to a temperature in the range from greater than 37° C. to about 95° C., or between about 55° C. to about 85° C., or between about 70° C. to about 75° C., or between about 70° C. to about 95° C., between about 90° C. to about 95° C., between about 95° C. to about 105° C., or between about 95° C. to about 110° C. In one aspect polypeptides of the invention can retain a xylanase, a mannanase and/or a glucanase activity after exposure to a temperature up to 100° C., 101° C., 102° C., 103° C., 103.5° C., 104° C., 105° C., 107° C., 108° C., 109° C. or 110° C. In one aspect polypeptides of the invention can retain a xylanase, a mannanase and/or a glucanase activity after exposure to a temperature up to 100° C., 101° C., 102° C., 103° C., 103.5° C., 104° C., 105° C., 107° C., 108° C., 109° C. or 110° C.

The invention provides isolated, synthetic or recombinant polypeptides comprising a polypeptide of the invention and lacking a signal sequence or a prepro sequence. The invention provides isolated, synthetic or recombinant polypeptides comprising a polypeptide of the invention and having a heterologous signal sequence or a heterologous prepro sequence.

In one aspect, a polypeptide of the invention has xylanase, a mannanase and/or a glucanase activity comprising a specific activity at about 37° C. in the range from about 100 to about 1000 units per milligram of protein, from about 500 to about 750 units per milligram of protein, from about 500 to about 1200 units per milligram of protein, or from about 750 to about 1000 units per milligram of protein. In one aspect, units are defined as 0.1 to 20 units/g of pulp, where a unit equals umol of xylose released per minute per mg of enzyme, using arabinoxylan as a substrate as described in the Nelson Somogyi assay, described in detail below. In alternative aspects, polypeptides of the invention have xylanase, a mannanase and/or a glucanase activity in the range of between about 0.05 to 20 units per gram of pulp, or 0.05, 0.10, 0.20, 0.30, 0.40, 0.50, 0.60, 0.70, 0.80, 0.90, 1.0, 1.5, 2.0, 2.5, 3.0, 3.5, 4.0, 4.5, 5.0, 5.5, 6.0, 6.5, 7, 8, 9, 10, 11, 12, 13, 14, 15, 16, 17, 18, 19 or 20 or more units per gram of pulp (where a unit equals umol of xylose released per minute per mg of enzyme, using arabinoxylan as a substrate as described in the Nelson Somogyi assay).

In one aspect, the thermotolerance comprises retention of at least half of the specific activity of the xylanase, a mannanase and/or a glucanase at 37° C. after being heated to an elevated temperature. The thermotolerance can comprise retention of specific activity at 37° C. in the range from about 500 to about 1200 units per milligram of protein after being heated to an elevated temperature.

In one aspect, the polypeptides of the invention comprise at least one glycosylation site or further comprises a polysaccharide. The glycosylation can be an N-linked glycosylation, e.g., wherein the polypeptide is glycosylated after being expressed in a P. pastoris or a S. pombe.

In one aspect, the xylanase, a mannanase and/or a glucanase activity of polypeptides of the invention retain activity under acidic conditions comprising about pH 6.5, pH 6, pH 5.5, pH 5, pH 4.5 or pH 4 or less (more acidic), or, retain a xylanase, a mannanase and/or a glucanase activity after exposure to acidic conditions comprising about pH 6.5, pH 6, pH 5.5, pH 5, pH 4.5 or pH 4 or less (more acidic); or, retain activity under basic conditions comprising about pH 7, pH 7.5 pH 8.0, pH 8.5, pH 9, pH 9.5, pH 10, pH 10.5, pH 11, pH 11.5, pH 12, pH 12.5 or more (more basic) or, retain a xylanase, a mannanase and/or a glucanase activity after exposure to basic conditions comprising about pH 7, pH 7.5 pH 8.0, pH 8.5, pH 9, pH 9.5, pH 10, pH 10.5, pH 11, pH 11.5, pH 12, pH 12.5 or more (more basic). In one aspect, xylanase, a mannanase and/or a glucanase activity of polypeptides of the invention retain activity at a temperature of at least about 80° C., 81° C., 82° C., 83° C., 84° C., 85° C., 86° C., 87° C., 88° C., 89° C. or 90° C., and a basic pH of at least about pH 7.5 pH 8.0, pH 8.5, pH 9, pH 9.5, pH 10, pH 10.5, pH 11, pH 11.5, pH 12, pH 12.5 or more (more basic).

The invention provides protein preparation comprising a polypeptide of the invention, wherein the protein preparation comprises a liquid, a slurry, a solid or a gel. The invention provides heterodimers comprising a polypeptide of the invention and a second domain. The second domain can be a polypeptide and the heterodimer is a fusion protein. the second domain can be an epitope or a tag.

The invention provides homodimers or heterodimers comprising a polypeptide of the invention. The invention provides immobilized polypeptides, wherein the polypeptide comprises a sequence of the invention, or a subsequence thereof, or a polypeptide encoded by a nucleic acid of the invention, or a polypeptide comprising a polypeptide of the invention and a second domain, e.g., wherein the polypeptide is immobilized on or inside a cell, a vesicle, a liposome, a film, a membrane, a metal, a resin, a polymer, a ceramic, a glass, a microelectrode, a graphitic particle, a bead, a gel, a plate, an array, a capillary tube, a crystal, a tablet, a pill, a capsule, a powder, an agglomerate, a surface, a porous structure, or materials such as wood chips, brownstock, pulp, paper, and materials deriving therefrom.

The xylanases and/or a glucanases of the invention can be used or formulated alone or as mixture (a "cocktail") of xylanases and/or a glucanases, and other hydrolytic enzymes such as cellulases, mannanases, proteases, lipases, amylases, or redox enzymes such as laccases, peroxidases, catalases, oxidases, or reductases. They can be used formulated in a solid form such as a powder, a lyophilized preparation, a granule, a tablet, a bar, a crystal, a capsule, a pill, a pellet, or in a liquid form such as in an aqueous solution, an aerosol, a gel, a paste, a slurry, an aqueous/oil emulsion, a cream, a capsule, or in a vesicular or micellar suspension. The formulations of the invention can comprise any or a combination of the following ingredients: polyols such as a polyethylene glycol, a polyvinylalcohol, a glycerol, a sugar such as a sucrose, a sorbitol, a trehalose, a glucose, a fructose, a maltose, a mannose, a gelling agent such as a guar gum, a carageenan, an alginate, a dextrans, a cellulosic derivative, a pectin, a salt such as a sodium chloride, a sodium sulfate, an ammonium sulfate, a calcium chloride, a magnesium chloride, a zinc chloride, a zinc sulfate, a salt of a fatty acid and a fatty acid derivative, a metal chelator such as an EDTA, an EGTA, a sodium citrate, an antimicrobial agent such as a fatty acid or a fatty acid derivative, a paraben, a sorbate, a benzoate, an additional modulating compound to block the impact of an enzyme such as a protease, a bulk proteins such as a BSA, a wheat hydrolysate, a borate compound, an amino acid or a peptide, an appropriate pH or temperature modulating compound, an emulsifier such as a non-ionic and/or an ionic detergent, a redox agent such as a cystine/cysteine, a glutathione, an oxidized glutathione, a reduced or an antioxidant compound such as an ascorbic acid, or a dispersant. Cross-linking and protein modification such as pegylation, fatty acid modification, glycosylation can also be used to improve enzyme stability.

The invention provides arrays comprising immobilized polypeptide(s) and/or nucleic acids of the invention, and arrays comprising an immobilized oligonucleotide of the invention. The enzymes, fragments thereof and nucleic acids which encode the enzymes, or probes of the invention, and fragments thereof, can be affixed to a solid support; and these embodiments can be economical and efficient in the use of enzymes and nucleic acids of the invention in industrial, medical, research, pharmaceutical, food and feed and food and feed supplement processing and other applications and processes. For example, a consortium or cocktail of enzymes (or active fragments thereof), which are used in a specific chemical reaction, can be attached to a solid support and dunked into a process vat. The enzymatic reaction can occur. Then, the solid support can be taken out of the vat, along with the enzymes affixed thereto, for repeated use. In one embodiment of the invention, the isolated nucleic acid is affixed to a solid support. In another embodiment of the invention, the solid support is selected from the group of a gel, a resin, a polymer, a ceramic, a glass, a microelectrode and any combination thereof.

For example, solid supports useful in this invention include gels. Some examples of gels include sepharose, gelatin, glutaraldehyde, chitosan-treated glutaraldehyde, albumin-glutaraldehyde, chitosan-Xanthan, toyopearl gel (polymer gel), alginate, alginate-polylysine, carrageenan, agarose, glyoxyl agarose, magnetic agarose, dextran-agarose, poly(Carbamoyl Sulfonate) hydrogel, BSA-PEG hydrogel, phosphorylated polyvinyl alcohol (PVA), monoaminoethyl-N-aminoethyl (MANA), amino, or any combination thereof. Another solid support useful in the present invention are resins or polymers. Some examples of resins or polymers include cellulose, acrylamide, nylon, rayon, polyester, anion-exchange resin, AMBERLITE™ XAD-7, AMBERLITE™ XAD-8, AMBERLITE™ IRA-94, AMBERLITE™ IRC-50, polyvinyl, polyacrylic, polymethacrylate, or any combination thereof. Another type of solid support useful in the present invention is ceramic. Some examples include non-porous ceramic, porous ceramic, $SiO_2$, $Al_2O_3$. Another type of solid support useful in the present invention is glass. Some examples include non-porous glass, porus glass, aminopropyl glass or any combination thereof. Another type of solid support which can be used is a microelectrode. An example is a polyethyleneimine-coated magnetite. Graphitic particles can be used as a solid support. Another example of a solid support is a cell, such as a red blood cell.

There are many methods which would be known to one of skill in the art for immobilizing enzymes or fragments thereof, or nucleic acids, onto a solid support. Some examples of such methods include electrostatic droplet generation, electrochemical means, via adsorption, via covalent binding, via cross-linking, via a chemical reaction or process, via encapsulation, via entrapment, via calcium alginate, or via poly (2-hydroxyethyl methacrylate). Like methods are described in *Methods in Enzymology, Immobilized Enzymes and Cells*, Part C. 1987. Academic Press. Edited by S. P. Colowick and N. O. Kaplan. Volume 136; and *Immobilization of Enzymes and Cells*. 1997. Humana Press. Edited by G. F. Bickerstaff. Series: Methods in Biotechnology, Edited by J. M. Walker.

The invention provides isolated, synthetic or recombinant antibodies that specifically binds to a polypeptide of the invention. The antibody can be a monoclonal or a polyclonal antibody, or is a single chained antibody. The invention provides hybridomas comprising an antibody that specifically binds to a polypeptide of the invention.

The invention provides methods of isolating or identifying a polypeptide with a xylanase, a mannanase and/or a glucanase activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having a xylanase, a mannanase and/or a glucanase activity. The invention provides methods of making an anti-xylanase and/or anti-glucanase antibody comprising administering to a non-human animal a nucleic acid of the invention or a subsequence thereof in an amount sufficient to generate a humoral immune response, thereby making an anti-xylanase and/or anti-glucanase antibody. The invention provides methods of making an anti-xylanase and/or anti-glucanase antibody comprising administering to a non-human animal a polypeptide of the invention or a subsequence thereof in an amount sufficient to generate a humoral immune response, thereby making an anti-xylanase and/or anti-glucanase antibody.

The invention provides methods of producing a recombinant polypeptide comprising the steps of: (a) providing a nucleic acid operably linked to a promoter, wherein the nucleic acid comprises a sequence of the invention; and (b) expressing the nucleic acid of step (a) under conditions that allow expression of the polypeptide, thereby producing a recombinant polypeptide. The method can further comprise transforming a host cell with the nucleic acid of step (a) followed by expressing the nucleic acid of step (a), thereby producing a recombinant polypeptide in a transformed cell.

The invention provides methods for identifying a polypeptide having a xylanase, a mannanase and/or a glucanase activity comprising the following steps: (a) providing a polypeptide of the invention; (b) providing a xylanase, a mannanase and/or a glucanase substrate; and (c) contacting the polypeptide with the substrate of step (b) and detecting a decrease in the amount of substrate or an increase in the amount of a reaction product, wherein a decrease in the amount of the substrate or an increase in the amount of the reaction product detects a polypeptide having a xylanase, a mannanase and/or a glucanase activity.

The invention provides methods for identifying a xylanase, a mannanase and/or a glucanase substrate comprising the following steps: (a) providing a polypeptide of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a xylanase, a mannanase and/or a glucanase substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid has a sequence of the invention; (b) providing a test compound; (c) contacting the polypeptide with the test compound; and (d) determining whether the test compound of step (b) specifically binds to the polypeptide.

The invention provides methods of determining whether a test compound specifically binds to a polypeptide comprising the following steps: (a) providing a polypeptide of the invention; (b) providing a test compound; (c) contacting the polypeptide with the test compound; and (d) determining whether the test compound of step (b) specifically binds to the polypeptide.

The invention provides methods for identifying a modulator of a xylanase, a mannanase and/or a glucanase activity comprising the following steps: (a) providing a polypeptide of the invention; (b) providing a test compound; (c) contacting the polypeptide of step (a) with the test compound of step (b) and measuring an activity of the xylanase, a mannanase and/or a glucanase, wherein a change in the xylanase, a mannanase and/or a glucanase activity measured in the presence of the test compound compared to the activity in the absence of the test compound provides a determination that the test compound modulates the xylanase, a mannanase and/or a glucanase activity. The xylanase, a mannanase and/or a glucanase activity can be measured by providing a xylanase, a mannanase and/or a glucanase substrate and detecting a decrease in the amount of the substrate or an increase in the amount of a reaction product, or, an increase in the amount of the substrate or a decrease in the amount of a reaction product. In one aspect, a decrease in the amount of the substrate or an increase in the amount of the reaction product with the test compound as compared to the amount of substrate or reaction product without the test compound identifies the test compound as an activator of a xylanase, a mannanase and/or a glucanase activity. In one aspect, an increase in the amount of the substrate or a decrease in the amount of the reaction product with the test compound as compared to the amount of substrate or reaction product without the test compound identifies the test compound as an inhibitor of a xylanase, a mannanase and/or a glucanase activity.

The invention provides computer systems comprising a processor and a data storage device wherein said data storage device has stored thereon a polypeptide sequence or a nucleic acid sequence, wherein the polypeptide sequence comprises sequence of the invention, a polypeptide encoded by a nucleic acid of the invention. The computer systems can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having a xylanase, a mannanase and/or a glucanase activity from an environmental sample comprising the steps of: (a) providing an amplification primer sequence pair for amplifying a nucleic acid encoding a polypeptide having a xylanase, a mannanase and/or a glucanase activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having a xylanase, a mannanase and/or a glucanase activity from an environmental sample. One or each member of the amplification primer sequence pair can comprise an oligonucleotide comprising at least about 10 to 50 consecutive bases of a sequence of the invention. In one aspect, the amplification primer sequence pair is an amplification pair of the invention.

The invention provides methods for isolating or recovering a nucleic acid encoding a polypeptide having a xylanase, a mannanase and/or a glucanase activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having a xylanase, a mannanase and/or a glucanase activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having a xylanase, a mannanase and/or a glucanase activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant xylanase, a mannanase and/or a glucanase polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), Gene Site Saturation Mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a xylanase, a mannanase and/or a glucanase having an altered or different activity or an altered or different stability from that of a polypeptide encoded by the template nucleic acid is produced. In one aspect, the variant xylanase, a mannanase and/or a glucanase polypeptide is thermotolerant, and retains some activity after being exposed to an elevated temperature. In another aspect, the variant xylanase, a mannanase and/or a glucanase polypeptide has increased glycosylation as compared to the xylanase, a mannanase and/or a glucanase encoded by a template nucleic acid. Alternatively, the variant xylanase, a mannanase and/or a glucanase polypeptide has a xylanase, a mannanase and/or a glucanase activity under a high temperature, wherein the xylanase, a mannanase and/or a glucanase encoded by the template nucleic acid is not active under the high temperature. In one aspect, the method can be iteratively repeated until a xylanase, a mannanase and/or a glucanase coding sequence having an altered codon usage from that of the template nucleic acid is produced. In another aspect, the method can be iteratively repeated until a xylanase, a mannanase and/or a glucanase gene having higher or lower level of message expression or stability from that of the template nucleic acid is produced. In another aspect, formulation of the final xylanase, a mannanase and/or a glucanase product enables an increase or modulation of the performance of the xylanase, a mannanase and/or a glucanase in the product.

The invention provides methods for modifying codons in a nucleic acid encoding a polypeptide having a xylanase, a mannanase and/or a glucanase activity to increase its expression in a host cell, the method comprising the following steps: (a) providing a nucleic acid of the invention encoding a polypeptide having a xylanase, a mannanase and/or a glucanase activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having a xylanase, a mannanase and/or a glucanase activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding a xylanase, a mannanase and/or a glucanase.

The invention provides methods for modifying codons in a nucleic acid encoding a polypeptide having a xylanase, a mannanase and/or a glucanase activity to increase its expression in a host cell, the method comprising the following steps: (a) providing a nucleic acid of the invention encoding a xylanase, a mannanase and/or a glucanase polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having a xylanase, a mannanase and/or a glucanase activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified xylanase, a mannanase and/or a glucanase active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a sequence of the invention, or a subsequence thereof, and the nucleic acid encodes a xylanase, a mannanase and/or a glucanase active site or a xylanase, a mannanase and/or a glucanase substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified xylanase, a mannanase and/or a glucanase active sites or substrate binding sites. In one aspect, the method comprises mutagenizing the first nucleic acid of step (a) by a method comprising an optimized directed evolution system, Gene Site Saturation Mutagenesis (GSSM), or a synthetic ligation reassembly (SLR). In one aspect, the method comprises mutagenizing the first nucleic acid of step (a) or variants by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (GeneReassembly, U.S. Pat. No. 6,537, 776), Gene Site Saturation Mutagenesis (GSSM), synthetic ligation reassembly (SLR) and a combination thereof. In one aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises a xylanase, a mannanase and/or a glucanase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing a xylanase, a mannanase and/or a glucanase enzyme, wherein the enzyme comprises a polypeptide of the invention, or, a polypeptide encoded by a nucleic acid of the invention, or a subsequence thereof, (b) providing a small molecule; and (c) reacting the enzyme of step (a) with the small molecule of step (b) under conditions that facilitate an enzymatic reaction catalyzed by the xylanase, a mannanase and/or a glucanase enzyme, thereby modifying a small molecule by a xylanase, a mannanase and/or a glucanase enzymatic reaction. In one aspect, the method can comprise a plurality of small molecule substrates for the enzyme of step (a), thereby generating a library of modified small molecules produced by at least one enzymatic reaction catalyzed by the xylanase, a mannanase and/or a glucanase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule that exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of a xylanase, a mannanase and/or a glucanase enzyme comprising the steps of: (a) providing a xylanase, a mannanase and/or a glucanase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for a xylanase, a mannanase and/or a glucanase activity, thereby determining a functional fragment of a xylanase, a mannanase and/or a glucanase enzyme. In one aspect, the xylanase, a mannanase and/or a glucanase activity is measured by providing a xylanase, a mannanase and/or a glucanase substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides isolated, synthetic or recombinant signal sequences consisting of, or comprising, a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43 or 1 to 44, of a polypeptide of the invention, including exemplary polypeptide sequences of the invention. The invention provides isolated, synthetic or recombinant signal sequences consisting of, or comprising sequences as set forth in Table 4, below.

The invention provides chimeric polypeptides comprising at least a first domain comprising a signal peptide (SP) and at least a second domain comprising a heterologous polypeptide or peptide comprising a sequence of the invention, or a subsequence thereof, wherein the heterologous polypeptide or peptide is not naturally associated with the signal peptide (SP). In one aspect, the signal peptide (SP) is not derived from a xylanase, a mannanase and/or a glucanase. The heterologous polypeptide or peptide can be amino terminal to, carboxy terminal to or on both ends of the signal peptide (SP) or a xylanase, a mannanase and/or a glucanase catalytic domain (CD). The invention provides isolated, synthetic or recombinant nucleic acids encoding a chimeric polypeptide, wherein the chimeric polypeptide comprises at least a first domain comprising signal peptide (SP) and at least a second domain comprising a heterologous polypeptide or peptide comprising a sequence of the invention, or a subsequence thereof, wherein the heterologous polypeptide or peptide is not naturally associated with the signal peptide (SP).

The invention provides methods of increasing thermotolerance or thermostability of a xylanase, a mannanase and/or a glucanase polypeptide, the method comprising glycosylating a xylanase, a mannanase and/or a glucanase polypeptide, wherein the polypeptide comprises at least thirty contiguous amino acids of a polypeptide of the invention; or a polypeptide encoded by a nucleic acid sequence of the invention, thereby increasing the thermotolerance or thermostability of the xylanase, a mannanase and/or a glucanase polypeptide. In one aspect, the xylanase, a mannanase and/or a glucanase specific activity can be thermostable or thermotolerant at a temperature in the range from greater than about 37° C. to about 85° C., 90° C., 95° C., 97° C. or more.

The invention provides methods for overexpressing a recombinant xylanase, a mannanase and/or a glucanase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant and seeds comprising the following steps: (a) introducing a heterologous nucleic acid sequence into the cell, wherein the heterologous nucleic sequence comprises a nucleic acid sequence of the invention, thereby producing a transformed plant or seed cell; and (b) producing a transgenic plant from the transformed cell or seed. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides methods for hydrolyzing, breaking up or disrupting a xylan-comprising composition comprising the following steps: (a) providing a polypeptide of the invention having a xylanase, a mannanase and/or a glucanase activity, or a polypeptide encoded by a nucleic acid of the invention; (b) providing a composition comprising a xylan; and (c) contacting the polypeptide of step (a) with the composition of step (b) under conditions wherein the xylanase, a mannanase and/or a glucanase hydrolyzes, breaks up or disrupts the xylan-comprising composition. In one aspect, the composition comprises a plant cell, a bacterial cell, a yeast cell, an insect cell, or an animal cell. Thus, the composition can comprise any plant or plant part, any xylan-containing food or feed, a waste product and the like.

The invention provides methods for liquefying or removing a xylan-comprising composition comprising the following steps: (a) providing a polypeptide of the invention having a xylanase activity, or a polypeptide encoded by a nucleic acid of the invention; (b) providing a composition comprising a xylan; and (c) contacting the polypeptide of step (a) with the composition of step (b) under conditions wherein the xylanase removes, softens or liquefies the xylan-comprising composition.

The invention provides detergent compositions comprising a polypeptide of the invention, or a polypeptide encoded by a nucleic acid of the invention, wherein the polypeptide has a xylanase, a mannanase and/or a glucanase activity. The xylanase can be a nonsurface-active xylanase, a mannanase and/or a glucanase or a surface-active xylanase, a mannanase and/or a glucanase. The xylanase, a mannanase and/or a glucanase can be formulated in a non-aqueous liquid composition, a cast solid, a granular form, a particulate form, a compressed tablet, a gel form, a paste or a slurry form. The invention provides methods for washing an object comprising the following steps: (a) providing a composition comprising a polypeptide of the invention having a xylanase, a mannanase and/or a glucanase activity, or a polypeptide encoded by a nucleic acid of the invention; (b) providing an object; and (c) contacting the polypeptide of step (a) and the object of step (b) under conditions wherein the composition can wash the object.

The invention provides textiles or fabrics, including, e.g., threads, comprising a polypeptide of the invention, or a polypeptide encoded by a nucleic acid of the invention. In one aspect, the textiles or fabrics comprise xylan-containing fibers. The invention provides methods for treating a textile or fabric (e.g., removing a stain from a composition) comprising the following steps: (a) providing a composition comprising a polypeptide of the invention having a xylanase, a mannanase and/or a glucanase activity, or a polypeptide encoded by a nucleic acid of the invention; (b) providing a textile or fabric comprising a xylan; and (c) contacting the polypeptide of step (a) and the composition of step (b) under conditions wherein the xylanase, a mannanase and/or a glucanase can treat the textile or fabric (e.g., remove the stain). The invention provides methods for improving the finish of a fabric comprising the following steps: (a) providing a composition comprising a polypeptide of the invention having a xylanase, a mannanase and/or a glucanase activity, or a polypeptide encoded by a nucleic acid of the invention; (b) providing a fabric; and (c) contacting the polypeptide of step (a) and the fabric of step (b) under conditions wherein the polypeptide can treat the fabric thereby improving the finish of the fabric. In one aspect, the fabric is a wool or a silk. In another aspect, the fabric is a cellulosic fiber or a blend of a natural fiber and a synthetic fiber.

The invention provides feeds or foods comprising a polypeptide of the invention, or a polypeptide encoded by a nucleic acid of the invention. The invention provides methods for hydrolyzing xylans in a feed or a food prior to consumption by an animal comprising the following steps: (a) obtaining a feed material comprising a xylanase, a mannanase and/or a glucanase of the invention, or a xylanase, a mannanase and/or a glucanase encoded by a nucleic acid of the invention; and (b) adding the polypeptide of step (a) to the feed or food material in an amount sufficient for a sufficient time period to cause hydrolysis of the xylan and formation of a treated food or feed, thereby hydrolyzing the xylans in the food or the feed prior to consumption by the animal. In one aspect, the invention provides methods for hydrolyzing xylans in a feed or a food after consumption by an animal comprising the following steps: (a) obtaining a feed material comprising a xylanase, a mannanase and/or a glucanase of the invention, or a xylanase, a mannanase and/or a glucanase encoded by a nucleic acid of the invention; (b) adding the polypeptide of step (a) to the feed or food material; and (c) administering the feed or food material to the animal, wherein after consumption, the xylanase, a mannanase and/or a glucanase causes hydrolysis of xylans in the feed or food in the digestive tract of the animal. The food or the feed can be, e.g., a cereal, a grain, a corn and the like.

The invention provides dough or bread products comprising a polypeptide having a xylanase, a mannanase and/or a glucanase activity, wherein the polypeptide comprises a sequence of the invention, or the polypeptide is encoded by a nucleic acid comprising a sequence of the invention, or an enzymatically active fragment thereof. The invention provides methods of dough conditioning comprising contacting a dough or a bread product with at least one polypeptide having a xylanase, a mannanase and/or a glucanase activity, wherein the polypeptide comprises a sequence of the invention, or the polypeptide is encoded by a nucleic acid comprising a sequence of the invention, or an enzymatically active fragment thereof, under conditions sufficient for conditioning the dough.

The invention provides beverages comprising a polypeptide having a xylanase, a mannanase and/or a glucanase activity, wherein the polypeptide comprises a sequence of the invention, or the polypeptide is encoded by a nucleic acid comprising a sequence of the invention. The invention provides methods of beverage production comprising administration of at least one polypeptide having a xylanase, a mannanase and/or a glucanase activity, wherein the polypeptide comprises a sequence of the invention, or the polypeptide is encoded by a nucleic acid comprising a sequence of the invention, or an enzymatically active fragment thereof, to a beverage or a beverage precursor under conditions sufficient for decreasing the viscosity of the beverage, wherein in one aspect (optionally) the beverage or beverage precursor is a wort or a beer.

The invention provides food or nutritional supplements for an animal comprising a polypeptide of the invention, e.g., a polypeptide encoded by the nucleic acid of the invention. In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the xylanase, a mannanase and/or a glucanase activity is thermotolerant. In another aspect, the xylanase, a mannanase and/or a glucanase activity is thermostable.

The invention provides a food, a feed or a nutritional supplement comprising a polypeptide of the invention. The invention provides methods for utilizing a xylanase, a mannanase and/or a glucanase as a nutritional supplement in an animal diet, the method comprising: preparing a nutritional supplement containing a xylanase, a mannanase and/or a glucanase enzyme comprising at least thirty contiguous amino acids of a polypeptide of the invention; and administering the nutritional supplement to an animal to increase utilization of a xylan contained in a feed or a food ingested by the animal. The animal can be a human, a ruminant or a monogastric animal. The xylanase, a mannanase and/or a glucanase enzyme can be prepared by expression of a polynucleotide encoding the xylanase, a mannanase and/or a glucanase in an organism selected from the group consisting of a bacterium, a yeast, a plant, an insect, a fungus and an animal. The organism can be selected from the group consisting of an *S. pombe, S. cerevisiae, Pichia pastoris, Pseudomonas* sp., *E. coli, Streptomyces* sp., *Bacillus* sp. and *Lactobacillus* sp.

The invention provides edible enzyme delivery matrix comprising a thermostable recombinant xylanase, a mannanase and/or a glucanase enzyme, e.g., a polypeptide of the invention. The invention provides methods for delivering a xylanase, a mannanase and/or a glucanase supplement to an animal, the method comprising: preparing an edible enzyme delivery matrix in the form of pellets comprising a granulate edible carrier and a thermostable recombinant xylanase, a mannanase and/or a glucanase enzyme, wherein the pellets readily disperse the xylanase, a mannanase and/or a glucanase enzyme contained therein into aqueous media, and administering the edible enzyme delivery matrix to the animal. The recombinant xylanase, a mannanase and/or a glucanase enzyme can comprise a polypeptide of the invention. The granulate edible carrier can comprise a carrier selected from the group consisting of a grain germ, a grain germ that is spent of oil, a hay, an alfalfa, a timothy, a soy hull, a sunflower seed meal and a wheat midd. The edible carrier can comprise grain germ that is spent of oil. The xylanase, a mannanase and/or a glucanase enzyme can be glycosylated to provide thermostability at pelletizing conditions. The delivery matrix can be formed by pelletizing a mixture comprising a grain germ and a xylanase, a mannanase and/or a glucanase. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

The invention provides methods for improving texture and flavor of a dairy product comprising the following steps: (a) providing a polypeptide of the invention having a xylanase, a mannanase and/or a glucanase activity, or a xylanase, a mannanase and/or a glucanase encoded by a nucleic acid of the invention; (b) providing a dairy product; and (c) contacting the polypeptide of step (a) and the dairy product of step (b) under conditions wherein the xylanase, a mannanase and/or a glucanase can improve the texture or flavor of the dairy product. In one aspect, the dairy product comprises a cheese or a yogurt. The invention provides dairy products comprising a xylanase, a mannanase and/or a glucanase of the invention, or is encoded by a nucleic acid of the invention.

The invention provides methods for improving the extraction of oil from an oil-rich plant material comprising the following steps: (a) providing a polypeptide of the invention having a xylanase, a mannanase and/or a glucanase activity, or a xylanase, a mannanase and/or a glucanase encoded by a nucleic acid of the invention; (b) providing an oil-rich plant material; and (c) contacting the polypeptide of step (a) and the oil-rich plant material. In one aspect, the oil-rich plant material comprises an oil-rich seed. The oil can be a soybean oil, an olive oil, a rapeseed (canola) oil or a sunflower oil.

The invention provides methods for preparing a fruit or vegetable juice, syrup, puree or extract comprising the following steps: (a) providing a polypeptide of the invention having a xylanase, a mannanase and/or a glucanase activity, or a xylanase, a mannanase and/or a glucanase encoded by a nucleic acid of the invention; (b) providing a composition or a liquid comprising a fruit or vegetable material; and (c) contacting the polypeptide of step (a) and the composition, thereby preparing the fruit or vegetable juice, syrup, puree or extract.

The invention provides papers or paper products or paper pulp comprising a xylanase, a mannanase and/or a glucanase of the invention, or a polypeptide encoded by a nucleic acid of the invention. The invention provides methods for treating a paper or a paper or wood pulp comprising the following steps: (a) providing a polypeptide of the invention having a xylanase, a mannanase and/or a glucanase activity, or a xylanase, a mannanase and/or a glucanase encoded by a nucleic acid of the invention; (b) providing a composition comprising a paper or a paper or wood pulp; and (c) contacting the polypeptide of step (a) and the composition of step (b) under conditions wherein the xylanase, a mannanase and/or a glucanase can treat the paper or paper or wood pulp.

The invention provides methods for reducing the amount of lignin (delignification), or solubilizing a lignin, in a paper or paper product, a paper waste, a wood, wood pulp or wood product, or a wood or paper recycling composition, comprising contacting the paper or paper product, wood, wood pulp or wood product, or wood or paper recycling composition with a polypeptide of the invention, or an enzymatically active fragment thereof.

The invention provides methods for hydrolyzing hemicelluloses in a wood, wood product, paper pulp, paper product or paper waste comprising contacting the wood, wood product, paper pulp, paper product or paper waste with a polypeptide of the invention, or an enzymatically active fragment thereof.

The invention provides methods for enzymatic bleaching of paper, hemp or flax pulp comprising contacting the paper, hemp or flax pulp with a xylanase, a mannanase and/or a glucanase and a bleaching agent, wherein the xylanase, a mannanase and/or a glucanase comprises a polypeptide of the invention, or an enzymatically active fragment thereof. The bleaching agent can comprise oxygen or hydrogen peroxide.

The invention provides methods for of bleaching a lignocellulose pulp comprising contacting the lignocellulose pulp with a xylanase, a mannanase and/or a glucanase, wherein the xylanase, a mannanase and/or a glucanase comprises a polypeptide of the invention, or an enzymatically active fragment thereof.

The invention provides methods for enzymatic deinking of paper, paper waste, paper recycled product, deinking toner from non-contact printed wastepaper or mixtures of non-contact and contact printed wastepaper, comprising contacting the paper, paper waste, paper recycled product, non-contact printed wastepaper or contact printed wastepaper with a xylanase, a mannanase and/or a glucanase, wherein the xylanase, a mannanase and/or a glucanase comprises a polypeptide of the invention, or an enzymatically active fragment thereof.

The invention provides methods for bleaching a thread, fabric, yarn, cloth or textile comprising contacting the fabric, yarn, cloth or textile with a xylanase, a mannanase and/or a glucanase under conditions suitable to produce a whitening of the textile, wherein the xylanase, a mannanase and/or a glucanase comprises a polypeptide of the invention, or an enzymatically active fragment thereof. The thread, fabric, yarn, cloth or textile can comprise a non-cotton cellulosic thread, fabric, yarn, cloth or textile. The invention provides fabrics, yarns, cloths or textiles comprising a polypeptide having a sequence of the invention, or a polypeptide encoded by a nucleic acid comprising a sequence of the invention, or an enzymatically active fragment thereof, wherein in one aspect (optionally) the fabric, yarn, cloth or textile comprises a non-cotton cellulosic fabric, yarn, cloth or textile.

The invention provides methods for bleaching or deinking newspaper comprising contacting the newspaper, wherein the xylanase, a mannanase and/or a glucanase comprises a polypeptide of the invention, or an enzymatically active fragment thereof.

The invention provides wood, wood chips, wood pulp, wood products, paper pulps, paper products, newspapers or paper waste comprising a polypeptide of the invention, or an enzymatically active fragment thereof. The invention provides thread, fabric, yarn, cloth or textile comprising a polypeptide of the invention, or an enzymatically active fragment thereof.

The invention provides methods for reducing lignin in a wood or wood product comprising contacting the wood or wood product with a polypeptide having a xylanase, a mannanase and/or a glucanase activity, wherein the polypeptide has a sequence of the invention, or the polypeptide is encoded by a nucleic acid comprising a sequence of the invention, or an enzymatically active fragment thereof.

The invention provides methods for reducing a lignin in a wood, a wood pulp, a Kraft pulp, a paper, a paper product or a paper pulp under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 80° C., 85° C., 90° C. or more, and a basic pH of at least about pH 10.5, pH 11, pH 12, pH 12.5 or more (basic) wherein the polypeptide comprises a xylanase, a mannanase and/or a glucanase having a sequence of the invention, or the xylanase, a mannanase and/or a glucanase is encoded by a nucleic acid comprising a sequence of the invention, or an enzymatically active fragment thereof; (b) providing a lignin-comprising wood, wood pulp, Kraft pulp, paper, paper product or paper pulp; and (c) contacting the wood, wood pulp, Kraft pulp, paper, paper product or paper pulp with the polypeptide of step (a) under conditions comprising a temperature of at least about 80° C., 85° C., 90° C. or more, and a basic pH of at least about pH 10.5, pH 11, pH 12, pH 12.5 or more (basic), wherein the polypeptide reduces the lignin in the wood, wood pulp, Kraft pulp, paper, paper product or paper pulp.

The invention provides methods for treating a wood, a wood pulp, a Kraft pulp, a paper product, a paper or a paper pulp under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 80° C., 85° C., 90° C. or more, and a basic pH of at least about pH 10.5, pH 11, pH 12, pH 12.5 or more (basic), wherein the polypeptide comprises a xylanase, a mannanase and/or a glucanase having a sequence of the invention, or the xylanase, a mannanase and/or a glucanase is encoded by a nucleic acid comprising a sequence of the invention; or an enzymatically active fragment thereof; (b) providing a wood, a wood pulp, a Kraft pulp, a paper, a paper product or a paper pulp; and (c) contacting the wood, wood pulp, Kraft pulp, paper, paper product or paper pulp with the polypeptide of step (a) under conditions comprising a temperature of at least about 80° C., 85° C., 90° C. or more, and a basic pH of at least about pH 10.5, pH 11, pH 12, pH 12.5 or more (basic), wherein the polypeptide catalyzes hydrolysis of compounds in the wood, wood pulp, Kraft pulp, paper, paper product or paper pulp, and wherein in one aspect (optionally) the wood, wood pulp, Kraft pulp, paper, paper product or paper pulp comprises a softwood and hardwood, or the wood, wood pulp, Kraft pulp, paper or paper pulp is derived from a softwood and hardwood; and wherein in one aspect (optionally) after the treatment the pulp has a consistency of at least about 10%, or at least about 32%.

The invention provides methods for decoloring a wood, a wood pulp, a Kraft pulp, a paper, a paper product or a paper pulp under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 80° C., 85° C., 90° C. or more, and a basic pH of at least about pH 10.5, pH 11, pH 12, pH 12.5 or more (basic), wherein the polypeptide comprises a xylanase, a mannanase and/or a glucanase having a sequence of the invention, or the xylanase, a mannanase and/or a glucanase is encoded by a nucleic acid comprising a sequence of the invention, or an enzymatically active fragment thereof; (b) providing a wood, a wood pulp, a Kraft pulp, a paper, a paper product or a paper pulp; and (c) contacting the wood, wood pulp, Kraft pulp, paper, paper product or paper pulp with the polypeptide of step (a) under conditions comprising a temperature of at least about 80° C., 85° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 9.5, pH 10.0, pH 10.5, pH 11, pH 12, pH 12.5 or more (basic), wherein the polypeptide catalyzes hydrolysis of compounds in the wood, wood pulp, Kraft pulp, paper, paper product or paper pulp, thereby bleaching the wood, wood pulp, Kraft pulp, paper, paper product or paper pulp.

The invention provides methods for reducing the use of bleaching chemicals in a wood, a wood pulp, a Kraft pulp, a paper, a paper product or a paper pulp bleaching process under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 80° C., 85° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 10.5, pH 11, pH 12, pH 12.5 or more (basic), wherein the polypeptide comprises a xylanase, a mannanase and/or a glucanase having a sequence of the invention, or the xylanase, a mannanase and/or a glucanase is encoded by a nucleic acid comprising a sequence of the invention, or an enzymatically active fragment thereof; (b) providing a wood, a wood pulp, a Kraft pulp, a paper, a paper product or a paper pulp; and (c) contacting the wood, wood pulp, Kraft pulp, paper, paper product or paper pulp with the polypeptide of step (a) under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 10.5, pH 11, pH 12, pH 12.5 or more (basic), wherein the polypeptide catalyzes hydrolysis of compounds in the wood, wood pulp, Kraft pulp, paper, paper product or paper pulp, thereby biobleaching the wood, wood pulp, Kraft pulp, paper, paper product or paper pulp and reducing the use of bleaching chemicals in the bleaching process; wherein in one aspect (optionally) the bleaching chemical comprises a chlorine, a chlorine dioxide, a caustic, a peroxide, or any combination thereof.

The invention provides methods for paper or pulp deinking under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, wherein the polypeptide comprises a xylanase, a mannanase and/or a glucanase having a sequence of the invention, or the xylanase, a mannanase and/or a glucanase is encoded by a nucleic acid comprising a sequence of the invention, or an enzymatically active fragment thereof; (b) providing an ink-comprising wood, wood pulp, Kraft pulp, paper, a paper product or paper pulp; and (c) contacting the wood, wood pulp, Kraft pulp, paper, paper product or paper pulp with the polypeptide of step (a) under conditions comprising a temperature of at least about 85° C. and a basic pH of at least about pH 11, wherein the polypeptide catalyzes hydrolysis of compounds in the wood, wood pulp, Kraft pulp, paper or paper pulp, thereby facilitating deinking of the wood, wood pulp, Kraft pulp, paper, paper product or paper pulp.

The invention provides methods for releasing a lignin from a wood, a wood pulp, a Kraft pulp, a paper, a paper product or a paper pulp under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, wherein the polypeptide comprises a xylanase, a mannanase and/or a glucanase having a sequence of the invention, or the xylanase, a mannanase and/or a glucanase is encoded by a nucleic acid comprising a sequence of the invention, or an enzymatically active fragment thereof; (b) providing a lignin-comprising wood, wood pulp, Kraft pulp, paper, paper product or paper pulp; and (c) contacting the wood, wood pulp, Kraft pulp, paper, paper product or a paper pulp of step (b) with the polypeptide of step (a) under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, wherein the polypeptide catalyzes hydrolysis of compounds in the wood, wood pulp, Kraft pulp, paper, paper product or paper pulp, thereby facilitating release of lignin from the wood, wood pulp, Kraft pulp, paper, paper product or paper pulp; wherein in one aspect (optionally) after the treatment the pulp has a consistency of about 10%.

The invention provides compositions comprising a wood, a wood pulp, a Kraft pulp, a paper, a paper product or a paper pulp comprising a polypeptide having a xylanase, a mannanase and/or a glucanase activity, wherein the polypeptide has a sequence of the invention, or the polypeptide is encoded by a nucleic acid comprising a sequence of the invention, or an enzymatically active fragment thereof, wherein in one aspect (optionally) the wood, wood pulp, Kraft pulp, paper, paper product or paper pulp comprises a softwood and hardwood, or the wood, wood pulp, Kraft pulp, paper, paper product or paper pulp derived from a softwood and hardwood.

The invention provides methods for making ethanol comprising contacting a starch-comprising composition with a polypeptide having a xylanase, a mannanase and/or a glucanase activity, wherein the polypeptide has a sequence of the invention, or the polypeptide is encoded by a nucleic acid comprising a sequence of the invention, or an enzymatically active fragment thereof. The invention provides compositions comprising an ethanol and a polypeptide having a xylanase, a mannanase and/or a glucanase activity, wherein the polypeptide has a sequence of the invention, or the polypeptide is encoded by a nucleic acid comprising a sequence of the invention, or an enzymatically active fragment thereof. The invention provides methods for making ethanol under high temperature and basic pH conditions, the method comprising the following steps: (a) providing at least one polypeptide having a xylanase, a mannanase and/or a glucanase activity, wherein the polypeptide retains xylanase, a mannanase and/or a glucanase activity under conditions comprising a temperature of at least about 8° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, wherein the polypeptide comprises a xylanase, a mannanase and/or a glucanase having a sequence of the invention, or the xylanase, a mannanase and/or a glucanase is encoded by a nucleic acid comprising a sequence of the invention, or an enzymatically active fragment thereof; (b) providing a starch-comprising composition comprising a wood, wood pulp, Kraft pulp, paper, a paper product or paper pulp; and (c) contacting the composition of step (b) with the polypeptide of step (a) under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, wherein the polypeptide catalyzes hydrolysis of compounds in the wood, wood pulp, Kraft pulp, paper or paper pulp, thereby generating ethanol from the wood, wood pulp, Kraft pulp, paper, paper product or paper pulp.

The invention provides pharmaceutical compositions comprising a polypeptide having a xylanase, a mannanase and/or a glucanase activity, wherein the polypeptide comprises a sequence of the invention, or the polypeptide is encoded by a nucleic acid comprising a sequence of the invention, or an enzymatically active fragment thereof. In one aspect, the invention provides methods for eliminating or protecting animals from a microorganism comprising a xylan comprising administering a polypeptide of the invention. The microorganism can be a bacterium comprising a xylan, e.g., *Salmonella*.

In one aspect, the pharmaceutical composition acts as a digestive aid or an anti-microbial (e.g., against *Salmonella*). In one aspect, the treatment is prophylactic. In one aspect, the invention provides oral care products comprising a polypeptide of the invention having a xylanase, a mannanase and/or a glucanase activity, or a xylanase, a mannanase and/or a glucanase encoded by a nucleic acid of the invention. The oral care product can comprise a toothpaste, a dental cream, a gel or a tooth powder, an odontic, a mouth wash, a pre- or post brushing rinse formulation, a chewing gum, a lozenge or a candy. The invention provides contact lens cleaning compositions comprising a polypeptide of the invention having a xylanase, a mannanase and/or a glucanase activity, or a xylanase, a mannanase and/or a glucanase encoded by a nucleic acid of the invention.

The invention provides chimeric glycosidases, xylanases and/or glucanases comprising a polypeptide (e.g., xylanase, a mannanase and/or a glucanase) sequence of the invention and at least one heterologous carbohydrate-binding module (CBM), wherein in one aspect (optionally) the CBM comprises a CBM3a, CBM3b, CBM4, CBM6, CBM22 or X14, or a CBM as listed and discussed, below. The invention also provides chimeric glycosidases, xylanases and/or glucanases comprising at least one heterologous carbohydrate-binding module (CBM), wherein the CBM comprises a carbohydrate-binding subsequence of a xylanase sequence of the invention, or a carbohydrate-binding subsequence comprising a X14 as set forth in Table 9. The invention provides methods for designing a chimeric glycosidase, xylanase, a mannanase and/or a glucanase having a new carbohydrate-binding specificity or an enhanced carbohydrate-binding specificity, comprising inserting a heterologous or an additional endogenous carbohydrate-binding module (CBM) into a glycosidases, xylanases and/or glucanases, wherein the CBM comprises a carbohydrate-binding subsequence of a glycosidase, xylanase, mannanase and/or glucanase sequence of the invention, or a carbohydrate-binding subsequence comprising a X14 as set forth in Table 9, or alternatively a heterologous CBM, or an additional endogenous CBM, is inserted into a xylanase, a mannanase and/or a glucanase sequence of the invention.

The invention provides enzyme mixtures, or "cocktails" comprising at least one enzyme of the invention and one or more other enzyme(s), which can be another xylanase, mannanase and/or glucanase, or any other enzyme; for example, the "cocktails" of the invention, in addition to at least one enzyme of this invention, can comprise any other enzyme, such as xylanase (not of this invention), cellulases, lipases, esterases, proteases, or endoglycosidases, endo-beta.-1,4-glucanases, beta-glucanases, endo-beta-1,3(4)-glucanases, cutinases, peroxidases, catalases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases, to name just a few examples. In alternative embodiments, these enzyme mixtures, or "cocktails" comprising at least one enzyme of the invention can be used in any process or method of the invention, or composition of the invention, e.g., in foods or feeds, food or feed supplements, textiles, papers, processed woods, etc. and methods for making them, and in compositions and methods for treating paper, pulp, wood, paper, pulp or wood waste or by-products, and the like, and in the final products thereof.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF THE DRAWINGS

The following drawings are illustrative of aspects of the invention and are not meant to limit the scope of the invention as encompassed by the claims.

The patent or application file contains at least one drawing executed in color. Copies of this patent or patent application publication with color drawing(s) will be provided by the Office upon request and payment of the necessary fee.

FIG. 7A illustrates the pH and temperature activity profiles for the enzymes SEQ ID NO:190 and SEQ ID NO:378, as described in detail in Example 5, below.

FIG. 7B illustrates the rate/temperature activity optima for the enzymes SEQ ID NO:190 and SEQ ID NO:378, as described in detail in Example 5, below.

FIG. 7C illustrates the thermal tolerance/residual activity for the enzymes SEQ ID NO:190 and SEQ ID NO:378, as described in detail in Example 5, below.

FIG. 15 is a table summarizing data demonstrating enzymatic activity of exemplary enzymes of the invention, as described in detail in Example 10, below.

Like reference symbols in the various drawings indicate like elements.

DETAILED DESCRIPTION OF THE INVENTION

The invention provides glycosyl hydrolases, including xylanases and/or a glucanases, and polynucleotides encoding them and methods of making and using them. Glycosyl hydrolase, including xylanase, mannanase and/or glucanase activity, of the polypeptides of the invention encompasses enzymes having hydrolase activity, for example, enzymes capable of hydrolyzing glycosidic linkages in a polysaccharide, for example a glycosidic linkage present in xylan, e.g., catalyzing hydrolysis of internal β-1,4-xylosidic linkages. The xylanases and/or a glucanases of the invention can be used to make and/or process foods, feeds, nutritional supplements, textiles, detergents and the like. The xylanases and/or a glucanases of the invention can be used in pharmaceutical compositions and dietary aids.

Xylanases and/or a glucanases of the invention are particularly useful in baking, animal feed, beverage and wood, wood pulp, Kraft pulp, paper, paper product or paper pulp processes. In one aspect, an enzyme of the invention is thermotolerant and/or tolerant of high and/or low pH conditions. For example, in one aspect, a xylanase, a mannanase and/or a glucanase of the invention retains activity under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, or more.

The invention provides variants of polynucleotides or polypeptides of the invention, which comprise sequences modified at one or more base pairs, codons, introns, exons, or amino acid residues (respectively) yet still retain the biological activity of a xylanase, a mannanase and/or a glucanase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), GSSM and any combination thereof.

Table 1 and Table 2 list variants obtained by mutating SEQ ID NO:189 (encoding SEQ ID NO:190) by GSSM. The invention provides nucleic acids having one or more, or all, of the sequences as set forth in Tables 1 and 2, i.e., nucleic acids having sequences that are variants of SEQ ID NO:189, where the variations are set forth in Table 1 and Table 2, and the polypeptides that are encoded by these variants.

Figure 5:
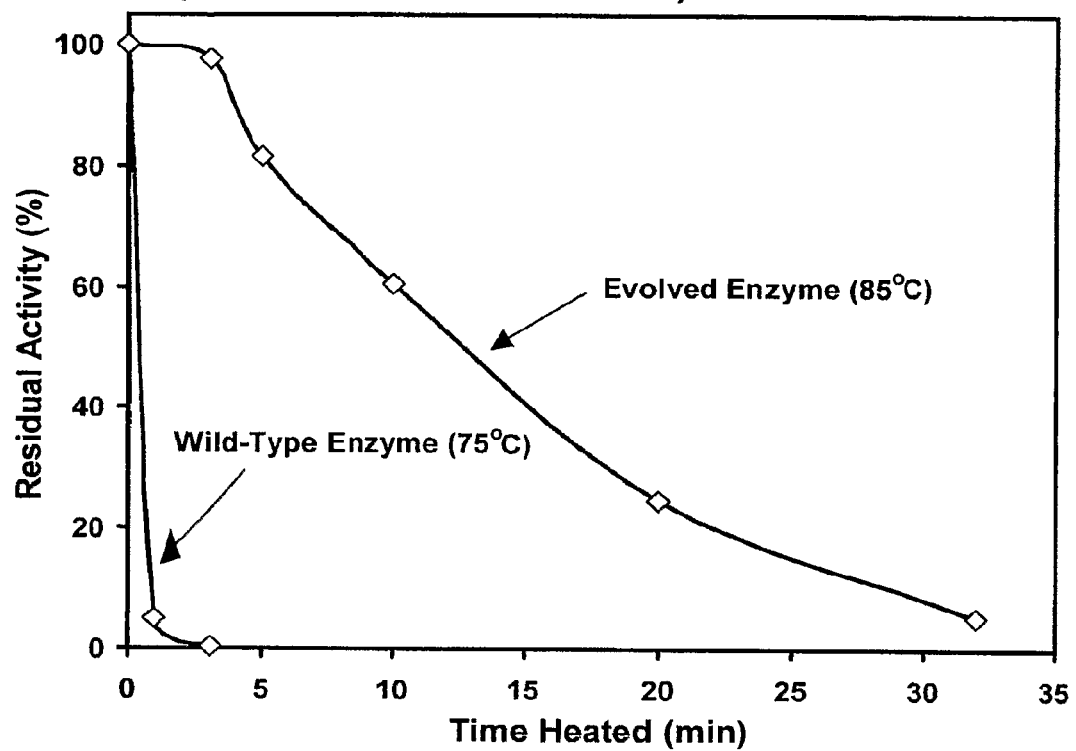
FIG. 5 is a graph comparing activity of the wild type sequence (SEQ ID NOS: 189 and 190) to the 8× mutant (SEQ ID NOS:375, 376), a combination of mutants D, F, H, I, S, V, X and AA in Table 1.

These GSSM variants (set forth in Tables 1 and 2) were tested for thermal tolerance (see Examples, below). Mutants D, F, G, H, I, J, K, S, T, U, V, W, X, Y, Z, AA, DD and EE were found to have the highest thermal tolerance among the mutants in Table 1. Mutants may also be combined to form a "larger" mutant (i.e., a polypeptide of the invention having multiple sequence variations, see also, e.g., Table 10, below). For example, mutants D, F, H, I, S, V, X and AA of Table 1 were combined to form a larger mutant termed "8×" with a sequence as set forth in SEQ ID NO:375 (polypeptide encoding nucleic acid) and SEQ ID NO:376 (amino acid sequence). FIG. 5 is a graph comparing the activity of the wild type sequence (SEQ ID NOS: 189 and 190) to the 8× mutant (SEQ ID NOS: 259 and 260). In comparing the wild type and the 8× mutant, it was discovered that the optimal temperature for both was 65° C. and that the optimal pH for both was 5.5. The wild type sequence was found to maintain its stability for less than 1 minute at 65° C., while the 8× mutant (SEQ ID NOS: 375, 376) was found to maintain its stability for more than 10 minutes at 85° C. The substrate used was azo-xylan (e.g., oat spelt, e.g., from Megazyme International Ireland Ltd). In one aspect, the 8× mutant (SEQ ID NOS:375, 376) was evolved by GSSM. In another aspect, the wild type is a GSSM parent for thermal tolerance evolution.

TABLE 1

| Mutant | Mutation | Wild type Seq | GSSM Seq |
|---|---|---|---|
| A | A2F | GCC | TTT |
| B | A2D | GCC | GAC |
| C | A5H | GCT | CAC |
| D | D8F | GAC | TTC |
| E | Q11L | CAA | CTC |
| F | Q11H | CAA | CAC |
| G | N12L | AAT | TTG |
| H | N12L | AAT | TTG |
| I | G17I | GGT | ATA |
| J | Q11H, T23T | CAA, ACC | CAT, ACG |
| K | Q11H | CAA | CAT |
| L | S26P | TCT | CCG |
| M | S26P | TCT | CCA |
| N | S35F | TCA | TTT |
| O | No Change | GTT | GTA |
| P | A51P | GCA | CCG |
| Q | A51P | GCA | CCG |
| R | G60R | GGA | CGC |
| S | G60H | GGA | CAC |
| T | G60H | GGA | CAC |
| U | P64C | CCG | TGT |
| V | P64V | CCG | GTA |

TABLE 1-continued

| Mutant | Mutation | Wild type Seq | GSSM Seq |
|---|---|---|---|
| W | P64V | CCG | GTT |
| X | S65V | TCC | GTG |
| Y | Q11H | CAA | CAT |
| Z | G68I | GGA | ATA |
| AA | G68A | GGA | GCT |
| BB | A71G | GCT | GGA |
| CC | No Change | AAT | AAC |
| DD | S79P | TCA | CCA |
| EE | S79P | TCA | CCC |
| FF | T95S | ACT | TCT |
| GG | Y98P | TAT | CCG |
| HH | T114S | ACT | AGC |
| II | No Change | AAC | AAC |
| JJ | No Change | AGG | AGA |
| KK | I142L | ATT | CTG |
| LL | S151I | AGC | ATC |
| MM | S138T, S151A | TCG, AGC | ACG, GCG |
| NN | K158R | AAG | CGG |
| OO | K160V, V172I | AAA, GTA | GTT, ATA |

The codon variants as set forth in Table 2 that produced variants (of SEQ ID NO:189) with the best variation or "improvement" over "wild type" (SEQ ID NO:189) in thermal tolerance are highlighted. As noted above, the invention provides nucleic acids, and the polypeptides that encode them, comprising one, several or all or the variations set forth in Table 2 and Table 1.

TABLE 2

| Mutation | Wild type Sequence | GSSM Sequence | Other codons also coding for same changed amino acid |
|---|---|---|---|
| A2F | GCC | TTT | TTC |
| A2D | GCC | GAC | GAT |
| A5H | GCT | CAC | CAT |
| D8F | GAC | TTC | TTT |
| Q11L | CAA | CTC | TTA, TTG, CTT, CTA, CTG |
| Q11H | CAA | CAC, CAT | — |
| N12L | AAT | TTG | TTA, CTC, CTT, CTA, CTG |
| G17I | GGT | ATA | ATT, ATC |
| T23T | ACC | ACG | ACT, AGC, ACA |
| S26P | TCT | CCG, CCA | CCC |
| S35F | TCA | TTT | TTC |

TABLE 2-continued

| Mutation | Wild type Sequence | GSSM Sequence | Other codons also coding for same changed amino acid |
|---|---|---|---|
| A51P | GCA | CCG | CCC, CCA |
| G60R | GGA | CGC | CGT, CGA, CGG, AGA, AGG |
| G60H | GGA | CAC | CAT |
| P64C | CCG | TGT | TGC |
| P64V | CCG | GTA, GTT | GTC, GTG |
| S65V | TCC | GTG | GTC, GTA, GTT |
| G68I | GGA | ATA | ATT, ATC |
| G68A | GGA | GCT | GCG, GCC, GCA |
| A71G | GCT | GGA | GGT, GGC, GGG |
| S79P | TCA | CCA, CCC | CCG |
| T95S | ACT | TCT | TCC, TCA, TCG, AGT, AGC |
| Y98P | TAT | CCG | CCC, CCA |
| T114S | ACT | AGC | TCC, TCA, TCG, AGT, TCT |
| I142L | ATT | CTG | TTA, CTC, CTT, CTA, TTG |
| S151I | AGC | ATC | ATT, ATA |
| S138T | TCG | ACG | ACT, ACC, ACA |
| S151A | AGC | GCG | GCT, GCC, GCA |
| K158R | AAG | CGG | CGT, CGA, CGC, AGA, AGG |
| K160V | AAA | GTT | GTC, GTA, GTG |
| V172I | GTA | ATA | ATT, ATC |

In one aspect the amino acid sequence of an amino acid sequence (SEQ ID NO: 208) of amino acid sequences of the invention is modified by a single amino acid mutation. In a specific aspect, that mutation is an asparagine to aspartic acid mutation. The resulting amino acid sequence and corresponding nucleic acid sequence are set forth as SEQ ID NO:252 and SEQ ID NO:251, respectively. Single amino acid mutations with an improvement in the pH optimum of the enzyme, such as the mutation of SEQ ID NO:208, have been shown in the art with respect to xylanases. (See, for example, Joshi, M., Sidhu, G., Pot, I., Brayer, G., Withers, S., McIntosh, L., *J. Mol. Bio.* 299, 255-279 (2000).) It is also noted that in such single amino acid mutations, portions of the sequences may be removed in the subcloning process. For example, SEQ ID NO:207 and SEQ ID NO:251 differ in only one nucleotide, over the area that the sequences align. However, it is noted that a 78 nucleotide area at the N-terminus of SEQ ID NO:207 was removed from the N-terminus of SEQ ID NO:251 in the subcloning. Additionally, the first three nucleotides in SEQ ID NO:251 were changed to ATG and then the point mutation was made at the sixth nucleotide in SEQ ID NO:251.

The term "saturation mutagenesis", "gene site saturation mutagenesis" or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Generating and Manipulating Nucleic Acids

The invention provides nucleic acids (e.g., nucleic acids encoding polypeptides having glycosyl hydrolase activity, e.g., a xylanase, a mannanase and/or a glucanase activity; including enzymes having at least one sequence modification of an exemplary nucleic acid sequence of the invention (as defined above), wherein the sequence modification comprises at least one, two, three, four, five, six, seven, eight, nine, ten, eleven, twelve, thirteen, fourteen, fifteen, sixteen, seventeen, eighteen, nineteen or all of the following changes: the nucleotides at the equivalent of residues 10 to 12 of SEQ ID NO:383 are changed to CCT, TTA, TTG, CTC, CTA or CTG, the nucleotides at the equivalent of residues 25 to 27 of SEQ ID NO:383 are changed to CCC, CCG, CCA or CCT, the nucleotides at the equivalent of residues 28 to 30 of SEQ ID NO:383 are changed to TCA, TCC, TCT, TCG, AGT or AGC, the nucleotides at the equivalent of residues 37 to 39 of SEQ ID NO:383 are changed to TTT or TTC, the nucleotides at the equivalent of residues 37 to 39 of SEQ ID NO:383 are changed to TAC or TAT, the nucleotides at the equivalent of residues 37 to 39 of SEQ ID NO:383 are changed to ATA, ATT or ATC, the nucleotides at the equivalent of residues 37 to 39 of SEQ ID NO:383 are changed to TGG, the nucleotides at the equivalent of residues 40 to 42 of SEQ ID NO:383 are changed to CAC or CAT, the nucleotides at the equivalent of residues 52 to 54 of SEQ ID NO:383 are changed to TTC or TTT, the nucleotides at the equivalent of residues 73 to 75 of SEQ ID NO:383 are changed to GAG or GAA, the nucleotides at the equivalent of residues 73 to 75 of SEQ ID NO:383 are changed to CCC, CCG, CCA or CCT, the nucleotides at the equivalent of residues 88 to 90 of SEQ ID NO:383 are changed to GTG, GTC, GTA or GTT, the nucleotides at the equivalent of residues 100 to 102 of SEQ ID NO:383 are changed to TGT or TGC, the nucleotides at the equivalent of residues 100 to 102 of SEQ ID NO:383 are changed to CAT or CAC, the nucleotides at the equivalent of residues 100 to 102 of SEQ ID NO:383-hre changed to TTG, TTA, CTT, CTC, CTA or CTG, the nucleotides at the equivalent of residues 103 to 105 of SEQ ID NO:383 are changed to GAG or GAA, the nucleotides at the equivalent of residues 103 to 105 of SEQ ID NO:383 are changed to GAT or GAC, the nucleotides at the equivalent of residues 211 to 213 of SEQ ID NO:383 are changed to ACA, ACT, ACC or ACG, the nucleotides at the equivalent of residues 211 to 213 of SEQ ID NO:383 are changed to TGT or TGC, or the nucleotides at the equivalent of residues 508 to 582 of SEQ ID NO:383 are changed to CAT or CAC), including expression cassettes such as expression vectors, encoding the polypeptides of the invention.

The invention also includes methods for discovering new xylanase, mannanase and/or glucanase sequences using the nucleic acids of the invention. The invention also includes methods for inhibiting the expression of xylanase, mannanase and/or glucanase genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like. For example, the following exemplary sequences of the invention were initially derived from the following sources:

TABLE 3

| SEQ ID | SOURCE |
|---|---|
| 1, 2 | Bacteria |
| 101, 102 | Environmental |
| 103, 104 | Bacteria |
| 105, 106 | Environmental |
| 107, 108 | Bacteria |
| 109, 110 | Environmental |
| 11, 12 | Environmental |
| 111, 112 | Environmental |
| 113, 114 | Environmental |
| 115, 116 | Environmental |
| 117, 118 | Environmental |
| 119, 120 | Environmental |
| 121, 122 | Environmental |
| 123, 124 | Environmental |
| 125, 126 | Environmental |
| 127, 128 | Environmental |
| 129, 130 | Bacteria |
| 13, 14 | Environmental |
| 131, 132 | Environmental |
| 133, 134 | Environmental |
| 135, 136 | Environmental |
| 137, 138 | Environmental |
| 139, 140 | Environmental |
| 141, 142 | Environmental |
| 143, 144 | Bacteria |
| 145, 146 | Eukaryote |
| 147, 148 | Environmental |
| 149, 150 | Environmental |
| 15, 16 | Environmental |
| 151, 152 | Environmental |
| 153, 154 | Environmental |
| 155, 156 | Environmental |
| 157, 158 | Environmental |
| 159, 160 | Environmental |
| 161, 162 | Environmental |
| 163, 164 | Environmental |
| 165, 166 | Environmental |
| 167, 168 | Environmental |
| 169, 170 | Environmental |
| 17, 18 | Bacteria |
| 171, 172 | Environmental |
| 173, 174 | Environmental |
| 175, 176 | Environmental |
| 177, 178 | Environmental |
| 179, 180 | Environmental |
| 181, 182 | Environmental |
| 183, 184 | Environmental |
| 185, 186 | Environmental |
| 187, 188 | Environmental |
| 189, 190 | Environmental |
| 19, 20 | Environmental |
| 191, 192 | Environmental |
| 193, 194 | Environmental |
| 195, 196 | Environmental |
| 197, 198 | Environmental |
| 199, 200 | Environmental |
| 201, 202 | Environmental |
| 203, 204 | Environmental |
| 205, 206 | Environmental |
| 207, 208 | Environmental |
| 209, 210 | Environmental |
| 21, 22 | Environmental |
| 211, 212 | Environmental |
| 213, 214 | Environmental |
| 215, 216 | Environmental |
| 217, 218 | Environmental |
| 219, 220 | Environmental |
| 221, 222 | Environmental |
| 223, 224 | Environmental |
| 225, 226 | Environmental |
| 227, 228 | Environmental |
| 229, 230 | Environmental |
| 23, 24 | Environmental |
| 231, 232 | Bacteria |
| 233, 234 | Environmental |
| 235, 236 | Environmental |
| 237, 238 | Environmental |
| 239, 240 | Environmental |
| 241, 242 | Environmental |
| 243, 244 | Environmental |
| 245, 246 | Environmental |
| 247, 248 | Environmental |
| 249, 250 | Environmental |
| 25, 26 | Environmental |
| 251, 252 | Environmental |
| 253, 254 | Environmental |
| 255, 256 | Environmental |
| 257, 258 | Environmental |
| 259, 260 | Environmental |
| 261, 262 | Environmental |
| 263, 264 | Environmental |
| 265, 266 | Environmental |
| 267, 268 | Bacteria |
| 269, 270 | Environmental |
| 27, 28 | Environmental |
| 271, 272 | Environmental |
| 273, 274 | Environmental |
| 275, 276 | Environmental |
| 277, 278 | Environmental |
| 279, 280 | Environmental |
| 281, 282 | Environmental |
| 283, 284 | Environmental |
| 285, 286 | Environmental |
| 287, 288 | Environmental |
| 289, 290 | Environmental |
| 29, 30 | Archaea |
| 291, 292 | Environmental |
| 293, 294 | Environmental |
| 295, 296 | Environmental |
| 297, 298 | Environmental |
| 299, 300 | Environmental |
| 3, 4 | Environmental |
| 301, 302 | Environmental |
| 303, 304 | Environmental |
| 305, 306 | Bacteria |
| 307, 308 | Environmental |
| 309, 310 | Environmental |
| 31, 32 | Environmental |
| 311, 312 | Environmental |
| 313, 314 | Bacteria |
| 315, 316 | Environmental |
| 317, 318 | Environmental |
| 319, 320 | Environmental |
| 321, 322 | Environmental |
| 323, 324 | Environmental |
| 325, 326 | Environmental |
| 327, 328 | Environmental |
| 329, 330 | Environmental |
| 33, 34 | Environmental |
| 331, 332 | Environmental |
| 333, 334 | Environmental |
| 335, 336 | Environmental |
| 337, 338 | Environmental |
| 339, 340 | Environmental |
| 341, 342 | Environmental |
| 343, 344 | Environmental |
| 345, 346 | Environmental |
| 347, 348 | Environmental |
| 349, 350 | Environmental |
| 35, 36 | Environmental |
| 351, 352 | Environmental |
| 353, 354 | Environmental |
| 355, 356 | Environmental |
| 357, 358 | Environmental |
| 359, 360 | Environmental |
| 361, 362 | Environmental |
| 363, 364 | Environmental |
| 365, 366 | Environmental |
| 367, 368 | Environmental |
| 369, 370 | Environmental |
| 37, 38 | Environmental |
| 371, 372 | Environmental |
| 373, 374 | Environmental |
| 375, 376 | Artificial |
| 377, 378 | Artificial |
| 39, 40 | Environmental |

TABLE 3-continued

| SEQ ID | SOURCE |
| --- | --- |
| 41, 42 | Environmental |
| 43, 44 | Environmental |
| 45, 46 | Environmental |
| 47, 48 | Environmental |
| 49, 50 | Environmental |
| 5, 6 | Environmental |
| 51, 52 | Environmental |
| 53, 54 | Bacteria |
| 55, 56 | Environmental |
| 57, 58 | Environmental |
| 59, 60 | Environmental |
| 61, 62 | Environmental |
| 63, 64 | Environmental |
| 65, 66 | Environmental |
| 67, 68 | Environmental |
| 69, 70 | Environmental |
| 7, 8 | Environmental |
| 71, 72 | Environmental |
| 73, 74 | Environmental |
| 75, 76 | Environmental |
| 77, 78 | Environmental |
| 79, 80 | Environmental |
| 81, 82 | Environmental |
| 83, 84 | Environmental |
| 85, 86 | Bacteria |
| 87, 88 | Environmental |
| 89, 90 | Bacteria |
| 9, 10 | Environmental |
| 91, 92 | Environmental |
| 93, 94 | Environmental |
| 95, 96 | Environmental |
| 97, 98 | Environmental |
| 99, 100 | Environmental |

In one aspect, the invention also provides xylanase- and/or glucanase-encoding nucleic acids with a common novelty in that they are derived from an environmental source, or a bacterial source, or an archaeal source.

In practicing the methods of the invention, homologous genes can be modified by manipulating a template nucleic acid, as described herein. The invention can be practiced in conjunction with any method or protocol or device known in the art, which are well described in the scientific and patent literature.

One aspect of the invention is an isolated nucleic acid comprising one of the sequences of The invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of a Sequence of the invention (or the sequences complementary thereto). The isolated, nucleic acids may comprise DNA, including cDNA, genomic DNA and synthetic DNA. The DNA may be double-stranded or single-stranded and if single stranded may be the coding strand or non-coding (anti-sense) strand. Alternatively, the isolated nucleic acids may comprise RNA.

Accordingly, another aspect of the invention is an isolated nucleic acid which encodes one of the polypeptides of the invention, or fragments comprising at least 5, 10, 15, 20, 25, 30, 35, 40, 50, 75, 100, or 150 consecutive amino acids of one of the polypeptides of the invention. The coding sequences of these nucleic acids may be identical to one of the coding sequences of one of the nucleic acids of the invention, or a fragment thereof or may be different coding sequences which encode one of the polypeptides of the invention, sequences substantially identical thereto and fragments having at least 5, 10, 15, 20, 25, 30, 35, 40, 50, 75, 100, or 150 consecutive amino acids of one of the polypeptides of the invention, as a result of the redundancy or degeneracy of the genetic code.

The genetic code is well known to those of skill in the art and can be obtained, for example, on page 214 of B. Lewin, *Genes VI*, Oxford University Press, 1997.

The isolated nucleic acid which encodes one of the polypeptides of the invention and sequences substantially identical thereto, may include, but is not limited to: only the coding sequence of a nucleic acid of the invention and sequences substantially identical thereto and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of the invention and sequences substantially identical thereto, may be mutagenized using conventional techniques, such as site directed mutagenesis, or other techniques familiar to those skilled in the art, to introduce silent changes into the polynucleotides of the invention and sequences substantially identical thereto. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention and sequences substantially identical thereto. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of The invention and sequences substantially identical thereto (or the sequences complementary thereto) under conditions of high, moderate, or low stringency as provided herein.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., glycosyl hydrolases of the invention) generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fission proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense strand, to peptide nucleic acid (PNA), or to any DNA-like or RNA-like material, natural or synthetic in origin. The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands that may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of" or a "nucleotide sequence encoding" a particular polypeptide or protein, is a nucleic acid sequence which is transcribed and translated into a polypeptide or protein when placed under the control of appropriate regulatory sequences.

The term "gene" means the segment of DNA involved in producing a polypeptide chain; it includes regions preceding and following the coding region (leader and trailer) as well as, where applicable, intervening sequences (introns) between individual coding segments (exons). "Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

The term "expression cassette" as used herein refers to a nucleotide sequence which is capable of affecting expression of a structural gene (i.e., a protein coding sequence, such as a xylanase, mannanase and/or glucanase of the invention) in a host compatible with such sequences. Expression cassettes include at least a promoter operably linked with the polypeptide coding sequence; and, in one aspect, with other sequences, e.g., transcription termination signals. Additional factors necessary or helpful in effecting expression may also be used, e.g., enhancers. Thus, expression cassettes also include plasmids, expression vectors, recombinant viruses, any form of recombinant "naked DNA" vector, and the like. A "vector" comprises a nucleic acid that can infect, transfect, transiently or permanently transduce a cell. It will be recognized that a vector can be a naked nucleic acid, or a nucleic acid complexed with protein or lipid. The vector in one aspect comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors that ensure that genes encoding proteins specific to a given tissue are expressed. Such factors are known to exist in mammals and plants so as to allow for specific tissues to develop.

As used herein, the term "isolated" means that the material (e.g., a nucleic acid, a polypeptide, a cell) is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. As used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. However, the term "purified" also includes nucleic acids that have been purified from the remainder of the genomic DNA or from other sequences in a library or other environment by at least one order of magnitude, typically two or three orders and more typically four or five orders of magnitude.

As used herein, the term "recombinant" means that the nucleic acid is adjacent to a "backbone" nucleic acid to which it is not adjacent in its natural environment. Additionally, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

"Plasmids" are designated by a lower case "p" preceded and/or followed by capital letters and/or numbers. The starting plasmids herein are either commercially available, publicly available on an unrestricted basis, or can be constructed from available plasmids in accord with published procedures. In addition, equivalent plasmids to those described herein are known in the art and will be apparent to the ordinarily skilled artisan. "Plasmids" can be commercially available, publicly available on an unrestricted basis, or can be constructed from available plasmids in accord with published procedures. Equivalent plasmids to those described herein are known in the art and will be apparent to the ordinarily skilled artisan.

"Digestion" of DNA refers to catalytic cleavage of the DNA with a restriction enzyme that acts only at certain sequences in the DNA. The various restriction enzymes used herein are commercially available and their reaction conditions, cofactors and other requirements were used as would be known to the ordinarily skilled artisan. For analytical purposes, typically 1 µg of plasmid or DNA fragment is used with about 2 units of enzyme in about 20 µl of buffer solution. For the purpose of isolating DNA fragments for plasmid construction, typically 5 to 50 µg of DNA are digested with 20 to 250 units of enzyme in a larger volume. Appropriate buffers and substrate amounts for particular restriction enzymes are specified by the manufacturer. Incubation times of about 1 hour at 37° C. are ordinarily used, but may vary in accordance with the supplier's instructions. After digestion, gel electrophoresis may be performed to isolate the desired fragment.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In particular, stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

For example, hybridization under high stringency conditions could occur in about 50% formamide at about 37° C. to 42° C. Hybridization could occur under reduced stringency conditions in about 35% to 25% formamide at about 30° C. to 35° C. In particular, hybridization could occur under high stringency conditions at 42° C. in 50% formamide, 5×SSPE, 0.3% SDS and 200 n/ml sheared and denatured salmon sperm DNA. Hybridization could occur under reduced stringency conditions as described above, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I. A promoter sequence is "operably linked to" a coding sequence when RNA polymerase which initiates transcription at the promoter will transcribe the coding sequence into mRNA.

Promoters suitable for expressing a polypeptide in bacteria include the *E. coli* lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the *E. coli* lac or trp promoters, the lacI promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK) and the acid phosphatase promoter. Fungal promoters include the ∀ factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryptic or eukaryotic cells or their viruses may also be used.

Tissue-Specific Plant Promoters

The invention provides expression cassettes that can be expressed in a tissue-specific manner, e.g., that can express a xylanase, mannanase and/or glucanase of the invention in a tissue-specific manner. The invention also provides plants or seeds that express a xylanase, mannanase and/or glucanase of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) *Plant Mol. Biol.* 33:125-139); Cat3 from *Arabidopsis* (GenBank No. U43147, Zhong (1996) *Mol. Gen. Genet.* 251:196-203); the gene encoding stearoyl-acyl carrier protein desaturase from *Brassica napus* (Genbank No. X74782, Solocombe (1994) *Plant Physiol.* 104: 1167-1176); GPc1 from maize (GenBank No. X15596; Martinez (1989) *J. Mol. Biol.* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro baciliform virus (RTBV), which replicates only in phloem cells in infected rice plants, with its promoter which drives strong phloem-specific reporter gene expression; the cassaya vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of xylanase- and/or glucanase-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids) can be operably linked to the Fbl2A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant. Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically—(e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the xylanase- and/or glucanase-producing nucleic acids of the invention will allow the grower to select plants with the optimal xylanase, mannanase and/or glucanase expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the *Agrobacterial* T-DNA.

The term "plant" (e.g., as in a transgenic plant or plant seed of this invention, or plant promoter used in a vector of the invention) includes whole plants, plant parts (e.g., leaves, stems, flowers, roots, etc.), plant protoplasts, seeds and plant cells and progeny of same; the classes of plants that can be used to practice this invention (including compositions and methods) can be as broad as the class of higher plants, including plants amenable to transformation techniques, including angiosperms (monocotyledonous and dicotyledonous plants), as well as gymnosperms; also including plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes, such a vectors) of the invention. Transgenic plants of the invention are also discussed, below.

Expression Vectors and Cloning Vehicles

The invention provides expression vectors and cloning vehicles comprising nucleic acids of the invention, e.g., sequences encoding the xylanases and/or glucanases of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal mini-chromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234:243-252), bean golden mosaic virus (see, e.g., Morinaga (1993) Microbiol Immunol. 37:471-476), cauliflower mosaic virus (see, e.g., Cecchini (1997) Mol. Plant. Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lacI, lacZ, T3, T7, gpt, lambda PR, PL and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of the invention and sequences substantially identical thereto, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. The nucleic acid can encode a fusion polypeptide in which one of the polypeptides of the invention and sequences substantially identical thereto, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., *Molecular Cloning: A Laboratory Manual 2nd Ed.*, Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al., *Molecular Cloning: A Laboratory Manual, 2nd Ed.*, Cold Spring Harbor, N.Y., (1989).

Host Cells and Transformed Cells

The invention also provides transformed cells comprising a nucleic acid sequence of the invention, e.g., a sequence encoding a xylanase, a mannanase and/or a glucanase of the invention, or a vector of the invention. The host cell may be any of the host cells familiar to those skilled in the art, including prokaryotic cells, eukaryotic cells, such as bacterial cells, fungal cells, yeast cells, mammalian cells, insect cells and/or plant cells. Exemplary bacterial cells include *E. coli, Streptomyces, Bacillus subtilis, Salmonella typhimurium* and various species within the genera *Pseudomonas, Streptomyces*, and *Staphylococcus*. Exemplary insect cells include *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750, 870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in E. coli.

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant xylanase, mannanase and/or glucanase in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a sequence of The invention over a region of at least about 100 residues, wherein the sequence identities are determined by analysis with a sequence comparison algorithm or by visual inspection, or, a nucleic acid that hybridizes under stringent conditions to a nucleic acid sequence of The invention, or a subsequence thereof. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention.

Additional details regarding this approach are in the public literature and/or are known to the skilled artisan. In a particular non-limiting exemplification, such publicly available literature includes EP 0659215 (WO 9403612 A1) (Nevalainen et al.); Lapidot, A., Mechaly, A., Shoham, Y., "Overexpression and single-step purification of a thermostable xylanase from *Bacillus stearothermophilus* T-6," J. Biotechnol. November 51:259-64 (1996); Lüthi, E., Jasmat, N. B., Bergquist, P. L., "Xylanase from the extremely thermophilic bacterium *Caldocellum saccharolyticum*: overexpression of the gene in *Escherichia coli* and characterization of the gene product," Appl. Environ. Microbiol. September 56:2677-83 (1990); and Sung, W. L., Luk, C. K., Zahab, D. M., Wakarchuk, W., "Overexpression of the *Bacillus subtilis* and circulans xylanases in *Escherichia coli*," Protein Expr. Purif. June 4:200-6 (1993), although these references do not teach the inventive enzymes of the instant application.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as *E. coli, Streptomyces, Bacillus subtilis, Salmonella typhimurium* and various species within the genera *Pseudomonas, Streptomyces* and *Staphylococcus*, fungal cells, such as yeast, insect cells such as *Drosophila* 52 and *Spodoptera* SJ9, animal cells such as CHO, COS or Bowes melanoma and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981) and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of amino acid sequences of the invention, or fragments comprising at least 5, 10, 15, 20, 25, 30, 35, 40, 50, 75, 100, or 150 consecutive amino acids thereof can be synthetically produced by conventional peptide synthesizers. In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of amino acid sequences of the invention, or fragments comprising at least 5, 10, 15, 20, 25, 30, 35, 40, 50, 75, 100, or 150 consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids of the invention and nucleic acids encoding the xylanases and/or glucanases of the invention, or modified nucleic acids of the invention, can be reproduced by amplification. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 12, 13, 14, 15, 16, 17, 18, 19, 20, 21, 22, 23, 24, or 25 residues of a nucleic acid of the invention, and about the first (the 5') 15, 16, 17, 18, 19, 20, 21, 22, 23, 24, or 25 residues of the complementary strand.

The invention provides an amplification primer sequence pair for amplifying a nucleic acid encoding a polypeptide having a xylanase, mannanase and/or glucanase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, or 25 consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 residues of a nucleic acid of the invention, and a second member having a sequence as set forth by about the first (the 5') 12, 13, 14, 15, 16, 17, 18, 19, 20, 21, 22, 23, 24, or 25 residues of the complementary strand of the first member. The invention provides xylanases and/or glucanases generated by amplification, e.g., polymerase chain reaction (PCR), using an amplification primer pair of the invention. The invention provides methods of making a xylanase, mannanase and/or glucanase by amplification, e.g., polymerase chain reaction (PCR), using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention (as defined above) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

As used herein, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. Typically, the substantial identity exists over a region of at least about 100 residues and most commonly the sequences are substantially identical over at least about 150-200 residues. In some aspects, the sequences are substantially identical over the entire length of the coding regions.

Additionally a "substantially identical" amino acid sequence is a sequence that differs from a reference sequence by one or more conservative or non-conservative amino acid substitutions, deletions, or insertions, particularly when such a substitution occurs at a site that is not the active site of the molecule and provided that the polypeptide essentially retains its functional properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a xylanase, mannanase and/or glucanase polypeptide, resulting in modification of the structure of the polypeptide, without significantly altering its biological activity. For example, amino- or carboxyl-terminal amino acids that are not required for xylanase, mannanase and/or glucanase biological activity can be removed. Modified polypeptide sequences of the invention can be assayed for xylanase, mannanase and/or glucanase biological activity by any number of methods, including contacting the modified polypeptide sequence with a xylanase, mannanase and/or glucanase substrate and determining whether the modified polypeptide decreases the amount of specific substrate in the assay or increases the bioproducts of the enzymatic reaction of a functional xylanase, mannanase and/or glucanase polypeptide with the substrate.

Nucleic acid sequences of the invention can comprise at least 10, 15, 20, 25, 30, 35, 40, 50, 75, 100, 150, 200, 300, 400, or 500 consecutive nucleotides of an exemplary sequence of the invention and sequences substantially identical thereto. Nucleic acid sequences of the invention can comprise homologous sequences and fragments of nucleic acid sequences and sequences substantially identical thereto, refer to a sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to these sequences. Homology may be determined using any of the computer programs and parameters described herein, including FASTA version 3.0t78 with the default parameters. Homologous sequences also include RNA sequences in which uridines replace the thymines in the nucleic acid sequences of the invention. The homologous sequences may be obtained using any of the procedures described herein or may result from the correction of a sequencing error. It will be appreciated that the nucleic acid sequences of the invention and sequences substantially identical thereto, can be represented in the traditional single character format (See the inside back cover of Stryer, Lubert.

Biochemistry, 3rd Ed., W. H Freeman & Co., New York.) or in any other format which records the identity of the nucleotides in a sequence.

Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402; 1996; Altschul et al., J. Mol. Biol. 215(3):403-410, 1990; Altschul et al., Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleinan & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project. At least twenty-one other genomes have already been sequenced, including, for example, *M. genitalium* (Fraser et al., 1995), *M. jannaschii* (Bult et al.; 1996), *H. influenzae* (Fleischmann et al., 1995), *E. coli* (Blattner et al., 1997) and yeast (*S. cerevisiae*) (Mewes et al., 1997) and *D. melanogaster* (Adams et al., 2000). Significant progress has also been made in sequencing the genomes of model organism, such as mouse, *C. elegans* and *Arabadopsis* sp. Several databases containing genomic information annotated with some functional information are maintained by different organization and are accessible via the internet One example of a useful algorithm is BLAST and BLAST 2.0 algorithms, which are described in Altschul et al., Nuc. Acids Res. 25:3389-3402, 1977 and Altschul et al., J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score.

Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N=-4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=-4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01 and most preferably less than about 0.001.

In one aspect, protein and nucleic acid sequence homologies are evaluated using the Basic Local Alignment Search Tool ("BLAST") In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

To determine and identify sequence identities, structural homologies, motifs and the like in silico, a nucleic acid or polypeptide sequence of the invention can be stored, recorded, and manipulated on any medium which can be read and accessed by a computer.

Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

The polypeptides of the invention include the exemplary sequences of the invention, and sequences substantially identical thereto, and fragments of any of the preceding sequences. Substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary sequence of the invention, e.g., a polypeptide sequences of the invention.

Homology may be determined using any of the computer programs and parameters described herein, including FASTA version 3.0t78 with the default parameters or with any modified parameters. The homologous sequences may be obtained using any of the procedures described herein or may result from the correction of a sequencing error. The polypeptide fragments comprise at least about 10, 15, 20, 25, 30, 35, 40, 45, 50, 75, 100, 150, 200, 250, 300, 350, 400, 450, 500 or more consecutive amino acids of the polypeptides of the invention and sequences substantially identical thereto. It will be appreciated that the polypeptide codes of amino acid sequences of the invention and sequences substantially identical thereto, can be represented in the traditional single character format or three letter format (See Stryer, Lubert. *Biochemistry* 3rd Ed., supra) or in any other format which relates the identity of the polypeptides in a sequence.

A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences of the invention and sequences substantially identical thereto, one or more of the polypeptide sequences of the invention and sequences substantially identical thereto. Another aspect of the invention is a computer readable medium having recorded thereon at least 2, 5, 10, 15, or 20 or more nucleic acid sequences of the invention and sequences substantially identical thereto.

Another aspect of the invention is a computer readable medium having recorded thereon one or more of the nucleic acid sequences of the invention and sequences substantially identical thereto. Another aspect of the invention is a computer readable medium having recorded thereon one or more of the polypeptide sequences of the invention and sequences substantially identical thereto. Another aspect of the invention is a computer readable medium having recorded thereon at least 2, 5, 10, 15, or 20 or more of the sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Figure 1:
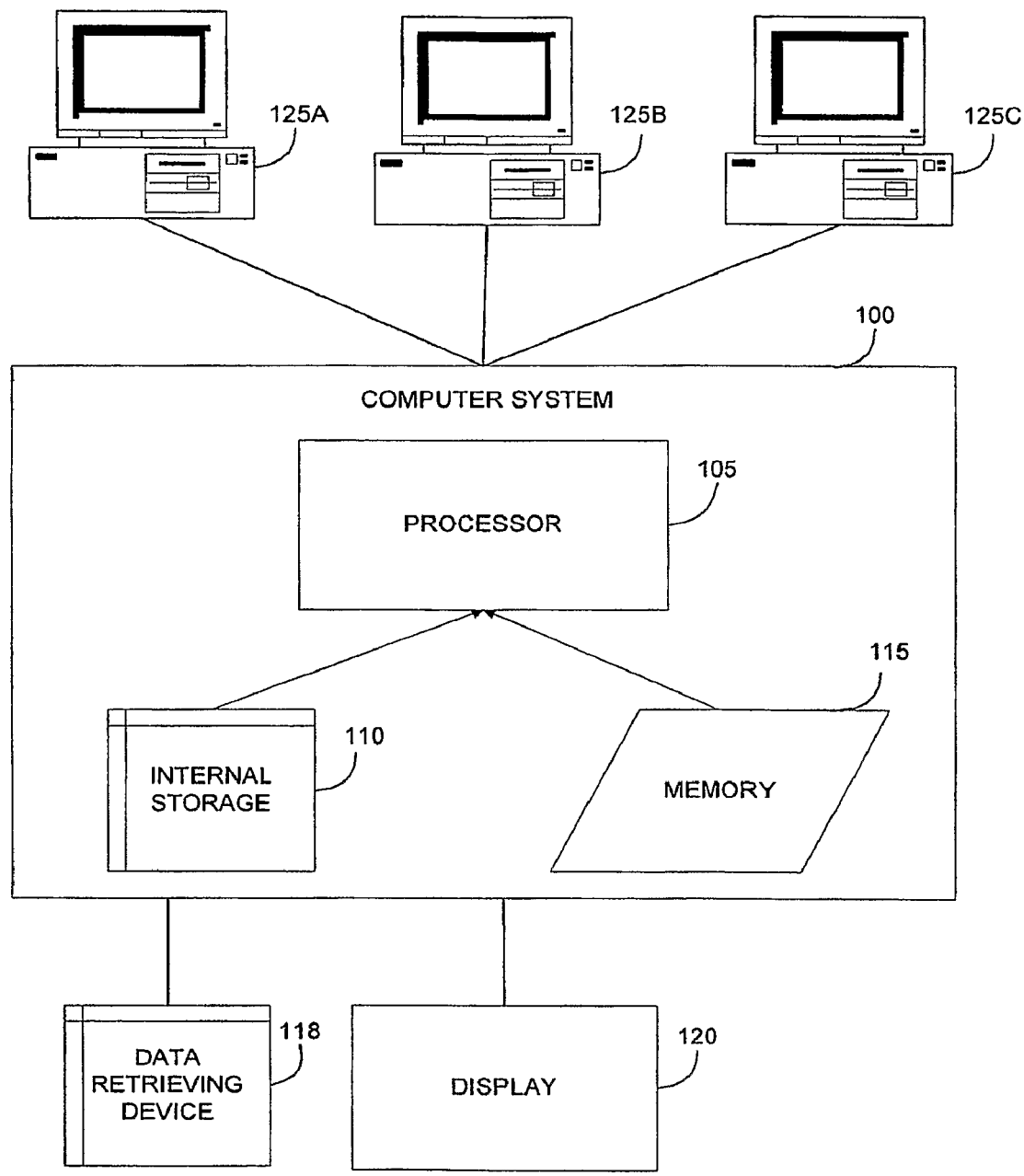
FIG. 1 is a block diagram of a computer system.

Aspects of the invention include systems (e.g., internet based systems), particularly computer systems which store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence of the invention and sequences substantially identical thereto, or a polypeptide sequence as set forth in the amino acid sequences of the invention. The computer system 100 typically includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

Typically the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

In one particular aspect, the computer system 100 includes a processor 105 connected to a bus which is connected to a main memory 115 (preferably implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a-c in a network or wide area network to provide centralized access to the computer system 100.

Software for accessing and processing the nucleotide sequences of a nucleic acid sequence of the invention and sequences substantially identical thereto, or a polypeptide sequence of the invention and sequences substantially identical thereto, (such as search tools, compare tools and modeling tools etc.) may reside in main memory 115 during execution.

In some aspects, the computer system 100 may further comprise a sequence comparison algorithm for comparing a nucleic acid sequence of the invention and sequences substantially identical thereto, or a polypeptide sequence of the invention and sequences substantially identical thereto, stored on a computer readable medium to a reference nucleotide or polypeptide sequencers) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence of the invention and sequences substantially identical thereto, or a polypeptide sequence of the invention and sequences substantially identical thereto, stored on a computer readable medium to reference sequences stored on a computer readable medium to identify homologies or structural motifs.

Figure 2:
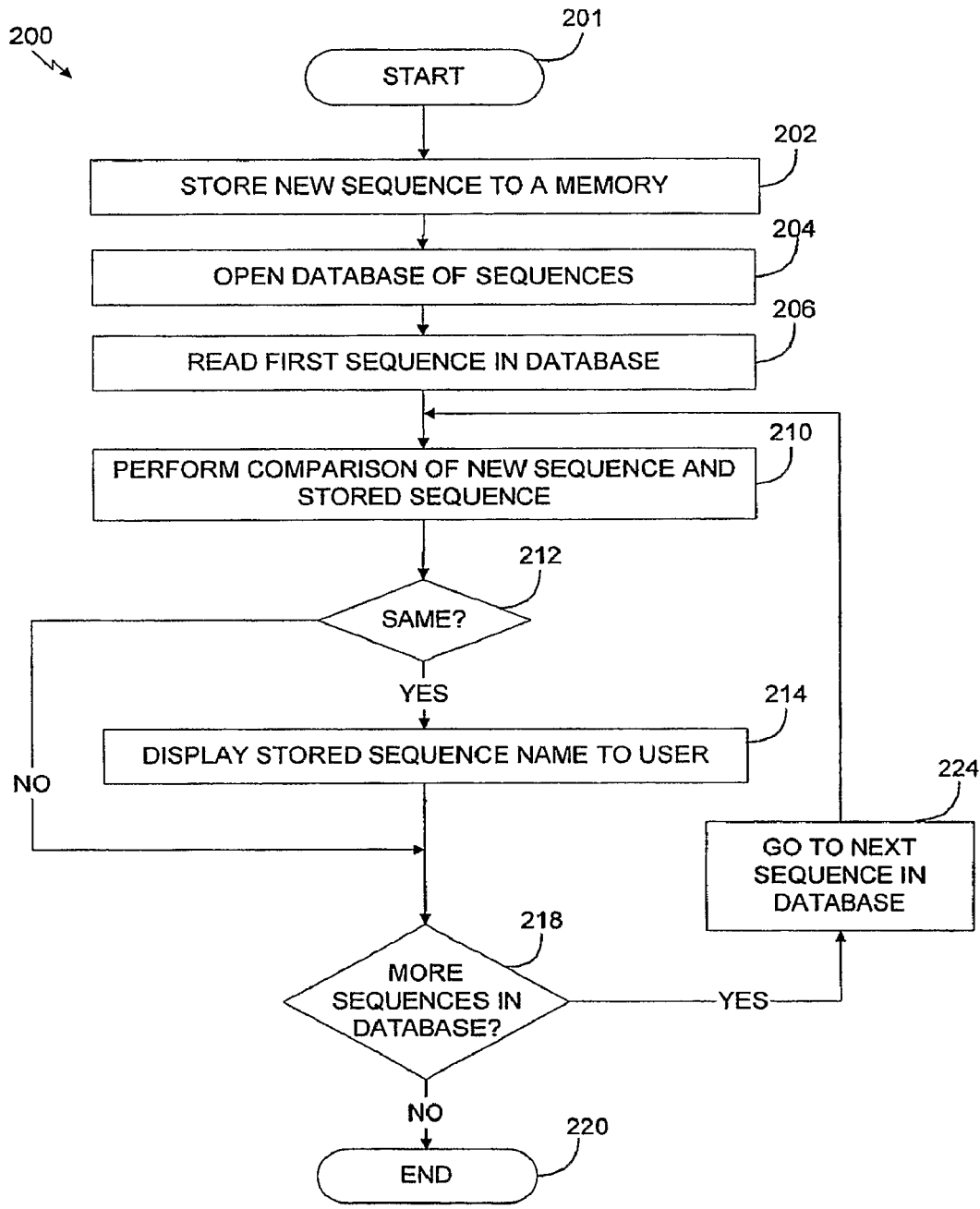
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence of the invention and sequences substantially identical thereto, or a polypeptide sequence of the invention and sequences substantially identical thereto, a data storage device having retrievably stored thereon reference nucleotide sequences or polypeptide sequences to be compared to a nucleic acid sequence of the invention and sequences substantially identical thereto, or a polypeptide sequence of the invention and sequences substantially identical thereto and a sequence comparer for conducting the comparison. The sequence comparer may indicate a homology level between the sequences compared or identify structural motifs in the above described nucleic acid code of nucleic acid sequences of the invention and sequences substantially identical thereto, or a polypeptide sequence of the invention and sequences substantially identical thereto, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences of the invention and sequences substantially identical thereto, or the polypeptide sequences of the invention and sequences substantially identical thereto.

Another aspect of the invention is a method for determining the level of homology between a nucleic acid sequence of the invention and sequences substantially identical thereto, or a polypeptide sequence of the invention and sequences substantially identical thereto and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, 30 or 40 or more of the above described nucleic acid sequences of the invention, or the polypeptide sequences of the invention through use of the computer program and determining homology between the nucleic acid codes or polypeptide codes and reference nucleotide sequences or polypeptide sequences.

Figure 3:
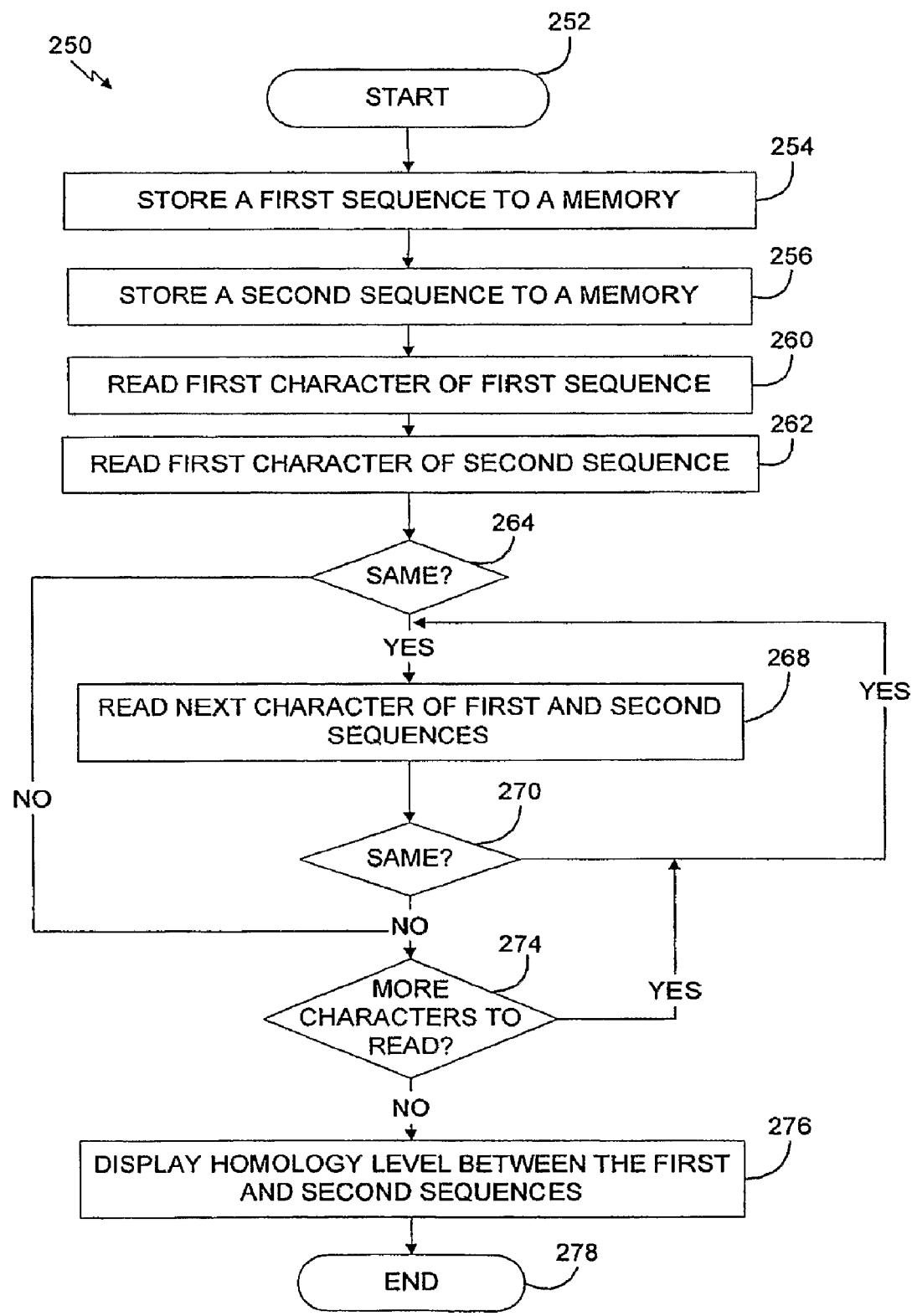
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is preferably in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of a nucleic acid sequence of the invention and sequences substantially identical thereto, differs from a reference nucleic acid sequence at one or more positions. In one aspect such a program records the length and identity of inserted, deleted or substituted nucleotides with respect to the sequence of either the reference polynucleotide or a nucleic acid sequence of the invention and sequences substantially identical thereto. In one aspect, the computer program may be a program which determines whether a nucleic acid sequence of the invention and sequences substantially identical thereto, contains a single nucleotide polymorphism (SNP) with respect to a reference nucleotide sequence.

Another aspect of the invention is a method for determining whether a nucleic acid sequence of the invention and sequences substantially identical thereto, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences of the invention and sequences substantially identical thereto and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence of the invention or a polypeptide sequence of the invention and sequences substantially identical thereto.

An "identifier" refers to one or more programs which identifies certain features within a nucleic acid sequence of the invention and sequences substantially identical thereto, or a polypeptide sequence of the invention and sequences substantially identical thereto. In one aspect, the identifier may comprise a program which identifies an open reading frame in a nucleic acid sequence of the invention and sequences substantially identical thereto.

Figure 4:
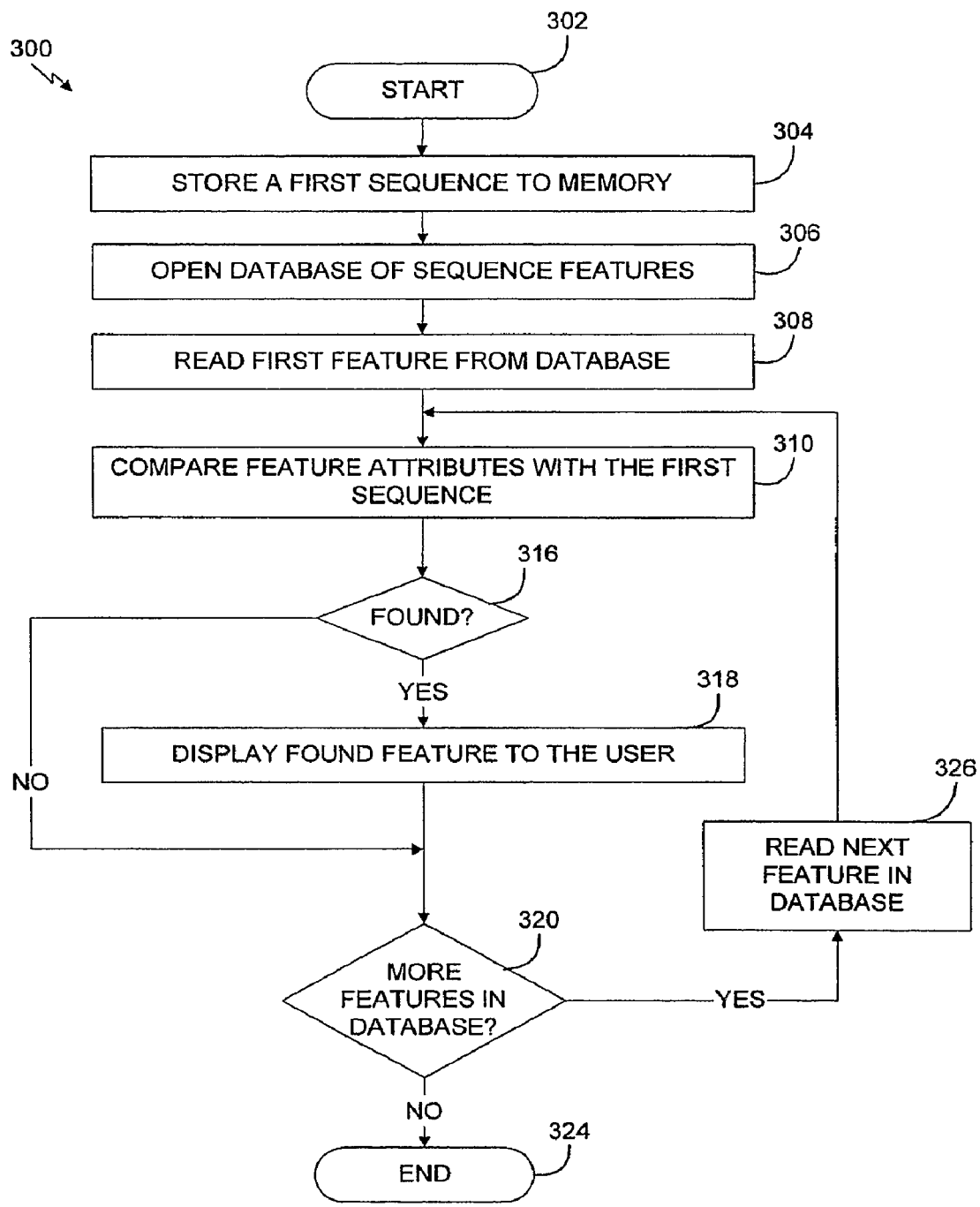
FIG. 4 is a flow diagram illustrating one aspect of an identifier process 300 for detecting the presence of a feature in a sequence.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence of the invention and sequences substantially identical thereto, or a polypeptide sequence of the invention and sequences substantially identical thereto, comprising reading the nucleic acid code(s) or polypeptide code(s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 of the nucleic acid sequences of the invention and sequences substantially identical thereto, or the polypeptide sequences of the invention and sequences substantially identical thereto, through the use of the computer program and identifying features within the nucleic acid codes or polypeptide codes with the computer program.

A nucleic acid sequence of the invention and sequences substantially identical thereto, or a polypeptide sequence of the invention and sequences substantially identical thereto, may be stored and manipulated in a variety of data processor programs in a variety of formats. For example, a nucleic acid sequence of the invention and sequences substantially identical thereto, or a polypeptide sequence of the invention and sequences substantially identical thereto, may be stored as text in a word processing file, such as Microsoft WORD™ or WORDPERFECT™ or as an ASCII file in a variety of database programs familiar to those of skill in the art, such as DB2™, SYBASE™, or ORACLE™. In addition, many computer programs and databases may be used as sequence comparison algorithms, identifiers, or sources of reference nucleotide sequences or polypeptide sequences to be compared to a nucleic acid sequence of the invention and sequences substantially identical thereto, or a polypeptide sequence of the invention and sequences substantially identical thereto. The following list is intended not to limit the invention but to provide guidance to programs and databases which are useful with the nucleic acid sequences of the invention and sequences substantially identical thereto, or the polypeptide sequences of the invention and sequences substantially identical thereto.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated, synthetic or recombinant nucleic acids that hybridize under stringent conditions to an exemplary sequence of the invention. The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 n/ml sheared and denatured salmon sperm DNA). In one aspect, nucleic acids of the invention are defined by their ability to hybridize under reduced stringency conditions comprising 35% formamide at a reduced temperature of 35° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM NaH$_2$PO$_4$, pH 7.0, 5.0 mM Na$_2$EDTA, 0.5% SDS, 10×Denhardt's and 0.5 mg/ml polyriboadenylic acid. Approximately 2×10$^7$ cpm (specific activity 4–9×10$^8$ cpm/ug) of $^{32}$P end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM Na$_2$EDTA) containing 0.5% SDS, followed by a 30 minute wash in fresh 1×SET at T$_m$–10° C. for the oligonucleotide probe. The membrane is then exposed to auto-radiographic film for detection of hybridization signals.

All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes- or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention. For example, the preceding methods may be used to isolate nucleic acids having a sequence with at least about 97%, at least 95%, at least 90%, at least 85%, at least 80%, at least 75%, at least 70%, at least 65%, at least 60%, at least 55%, or at least 50% homology to a nucleic acid sequence selected from the group consisting of one of the sequences of The invention and sequences substantially identical thereto, or fragments comprising at least about 10, 15, 20, 25, 30, 35, 40, 50, 75, 100, 150, 200, 300, 400, or 500 consecutive bases thereof and the sequences complementary thereto. Homology may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of The invention or the sequences complementary thereto.

Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% homology to a polypeptide having the sequence of one of amino acid sequences of the invention, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using them

The invention also provides nucleic acid probes that can be used, e.g., for identifying nucleic acids encoding a polypeptide with a xylanase, mannanase and/or glucanase activity or fragments thereof or for identifying xylanase, mannanase and/or glucanase genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated nucleic acids of The invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of The invention and sequences substantially identical thereto, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots.

Protocols for each of these procedures are provided in Ausubel et al. *Current Protocols in Molecular Biology*, John Wiley 503 Sons, Inc. (1997) and Sambrook et al., *Molecular Cloning: A Laboratory Manual 2nd Ed.*, Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", *PCR Methods and Applications* 1:5-16, 1991; E. Fahy et al., "Self-sustained Sequence Replication (3SR): An Isothermal Transcription-based Amplification System Alternative to PCR", *PCR Methods and Applications* 1:25-33, 1991; and Walker G. T. et al., "Strand Displacement Amplification—an Isothermal in vitro DNA Amplification Technique", *Nucleic Acid Research* 20:1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of The invention and sequences substantially identical thereto, may also be used in chromosome walking procedures to identify clones containing genomic sequences located adjacent to the sequences of The invention and sequences substantially identical thereto. Such methods allow the isolation of genes which encode additional proteins from the host organism.

The isolated nucleic acids of the invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of the invention and sequences substantially identical thereto, or the sequences complementary thereto may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\log [Na+])+0.41(\text{fraction } G+C)-(600/N)$ where N is the length of the probe.

If the hybridization is carried out in a solution containing formamide, the melting temperature may be calculated using the equation: $T_m=81.5+16.6(\log [Na+])+0.41 (\text{fraction } G+C)-(0.63\% \text{ formamide})-(600/N)$ where N is the length of the probe.

Prehybridization may be carried out in 6×SSC, 5×Denhardt's reagent, 0.5% SDS, 100 µg denatured fragmented salmon sperm DNA or 6×SSC, 5×Denhardt's reagent, 0.5% SDS, 100 µg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_m$. For shorter probes, such as oligonucleotide probes, the hybridization may be conducted at 5-10° C. below the $T_m$. Typically, for hybridizations in 6×SSC, the hybridization is conducted at approximately 68° C. Usually, for hybridizations in 50% formamide containing solutions, the hybridization is conducted at approximately 42° C.

Inhibiting Expression of Glycosyl Hydrolases

The invention provides nucleic acids complementary to (e.g., antisense sequences to) the nucleic acids of the invention, e.g., xylanase- and/or glucanase-encoding nucleic acids. Antisense sequences are capable of inhibiting the transport, splicing or transcription of xylanase- and/or glucanase-encoding genes. The inhibition can be effected through the targeting of genomic DNA or messenger RNA. The transcription or function of targeted nucleic acid can be inhibited, for example, by hybridization and/or cleavage. One particularly useful set of inhibitors provided by the present invention includes oligonucleotides which are able to either bind xylanase, mannanase and/or glucanase gene or message, in either case preventing or inhibiting the production or function of xylanase, mannanase and/or glucanase. The association can be through sequence specific hybridization. Another useful class of inhibitors includes oligonucleotides which cause inactivation or cleavage of xylanase, mannanase and/or glucanase message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of xylanase, mannanase and/or glucanase expression on a nucleic acid and/or protein level, e.g., antisense, iRNA and ribozymes comprising xylanase, mannanase and/or glucanase sequences of the invention and the anti-xylanase and/or anti-glucanase antibodies of the invention.

Inhibition of xylanase, mannanase and/or glucanase expression can have a variety of industrial, medical, pharmaceutical, research, food and feed and food and feed supplement processing and other applications and processes. For example, inhibition of xylanase, mannanase and/or glucanase expression can slow or prevent spoilage. Spoilage can occur when polysaccharides, e.g., structural polysaccharides, are enzymatically degraded. This can lead to the deterioration, or rot, of fruits and vegetables. In one aspect, use of compositions of the invention that inhibit the expression and/or activity of xylanases and/or glucanases, e.g., antibodies, antisense oligonucleotides, ribozymes and RNAi, are used to slow or prevent spoilage. Thus, in one aspect, the invention provides methods and compositions comprising application onto a plant or plant product (e.g., a cereal, a grain, a fruit, seed, root, leaf, etc.) antibodies, antisense oligonucleotides, ribozymes and RNAi of the invention to slow or prevent spoilage. These compositions also can be expressed by the plant (e.g., a transgenic plant) or another organism (e.g., a bacterium or other microorganism transformed with a xylanase, mannanase and/or glucanase gene of the invention).

The compositions of the invention for the inhibition of xylanase, mannanase and/or glucanase expression (e.g., antisense, iRNA, ribozymes, antibodies) can be used as pharmaceutical compositions, e.g., as anti-pathogen agents or in other therapies, e.g., as anti-microbials for, e.g., *Salmonella*.

Antisense Oligonucleotides

The invention provides antisense oligonucleotides capable of binding xylanase, mannanase and/or glucanase message which can inhibit xylan hydrolase activity (e.g., catalyzing hydrolysis of internal β-1,4-xylosidic linkages) by targeting mRNA. Strategies for designing antisense oligonucleotides are well described in the scientific and patent literature, and the skilled artisan can design such xylanase, mannanase and/or glucanase oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11: 191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense xylanase, mannanase and/or glucanase sequences of the invention (see, e.g., Gold (1995) J. of Biol. Chem. 270:13581-13584).

Inhibitory Ribozymes

The invention provides ribozymes capable of binding xylanase, mannanase and/or glucanase message. These ribozymes can inhibit xylanase, mannanase and/or glucanase activity by, e.g., targeting mRNA. Strategies for designing ribozymes and selecting the xylanase- and/or glucanase-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a xylanase, mannanase and/or glucanase enzyme sequence of the invention. The RNAi molecule can comprise a double-stranded RNA (dsRNA) molecule, e.g., siRNA, miRNA and/or short hairpin RNA (shRNA) molecules. The RNAi molecule, e.g., siRNA (small inhibitory RNA) can inhibit expression of a xylanase, mannanase and/or glucanase enzyme gene, and/or miRNA (micro RNA) to inhibit translation of a xylanase, mannanase and/or glucanase message. In one aspect, the RNAi molecule, e.g., siRNA and/or miRNA, is about 11, 12, 13, 14, 15, 16, 17, 18, 19, 20, 21, 22, 23, 24, 25, 26, 27, 28, 29 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's molecules, e.g., siRNA and/or miRNA, of the invention. The process may be practiced in vitro, ex vivo or in vivo. In one aspect, the RNAi molecules of the invention can be used to generate a loss-of-function mutation in a cell, an organ or an animal.

In one aspect, intracellular introduction of the RNAi is by internalization of a target cell specific ligand bonded to an RNA binding protein comprising an RNAi (e.g., microRNA) is adsorbed. The ligand is specific to a unique target cell surface antigen. The ligand can be spontaneously internalized after binding to the cell surface antigen. If the unique cell surface antigen is not naturally internalized after binding to its ligand, internalization can be promoted by the incorporation of an arginine-rich peptide, or other membrane permeable peptide, into the structure of the ligand or RNA binding protein or attachment of such a peptide to the ligand or RNA binding protein. See, e.g., U.S. Patent App. Pub. Nos. 20060030003; 20060025361; 20060019286; 20060019258. In one aspect, the invention provides lipid-based formulations for delivering, e.g., introducing nucleic acids of the invention as nucleic acid-lipid particles comprising an RNAi molecule to a cell, see e.g., U.S. Patent App. Pub. No. 20060008910.

Methods for making and using RNAi molecules, e.g., siRNA and/or miRNA, for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding a xylanase, mannanase and/or glucanase. These methods can be repeated or used in various combinations to generate xylanases and/or glucanases having an altered or different activity or an altered or different stability from that of a xylanase, mannanase and/or glucanase encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photo-activated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), gene site saturation mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crarneri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. Patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423,542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis (GSSM), synthetic ligation reassembly (SLR), or a combination thereof are used to modify the nucleic acids of the invention to generate xylanases and/or glucanases with new or altered properties (e.g., activity under highly acidic or alkaline conditions, high or low temperatures, and the like). Polypeptides encoded by the modified nucleic acids can be screened for an activity before testing for xylan hydrolysis or other activity. Any testing modality or protocol can be used, e.g., using a capillary array platform. See, e.g., U.S. Pat. Nos. 6,361,974; 6,280,926; 5,939,250.

Gene Site Saturation Mutagenesis, or, GSSM

The invention also provides methods for making enzyme using Gene Site Saturation mutagenesis, or, GSSM, as described herein, and also in U.S. Pat. Nos. 6,171,820 and 6,579,258. In one aspect, codon primers containing a degenerate N,N,G/T sequence are used to introduce point mutations into a polynucleotide, e.g., a xylanase, mannanase and/or glucanase or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, in one aspect, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position X 100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can in one aspect be used in combination with degenerate primers disclosed; for example, non-degenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., xylanases and/or glucanases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., *E. coli* host, using, e.g., an expression vector) and subjected to expression screening. When an individual progeny polypeptide is identified by screening to display a favorable change in property (when compared to the parental polypeptide, such as increased xylan hydrolysis activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process(es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (gene site saturation mutagenesis (GSSM)). The oligos used are comprised contiguously of a first homologous sequence, a degenerate N,N,N sequence and preferably but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence(s). In another aspect, oligos serviceable for introducing additions and deletions can be used either alone or in combination with the codons containing an N,N,N sequence, to introduce any combination or permutation of amino acid additions, deletions and/or substitutions.

In a particular exemplification, it is possible to simultaneously mutagenize two or more contiguous amino acid positions using an oligo that contains contiguous N,N,N triplets, i.e. a degenerate $(N,N,N)_n$ sequence.

In another aspect, the present invention provides for the use of degenerate cassettes having less degeneracy than the N,N,N sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can in one aspect be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable *E. coli* host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is preferably every integer from 15 to 100,000. Thus, instead of mutagenizing every position along a molecule, one can subject every or a discrete number of bases (preferably a subset totaling from 15 to 100,000) to mutagenesis. Preferably, a separate nucleotide is used for mutagenizing each position or group of positions along a polynucleotide sequence. A group of 3 positions to be mutagenized may be a codon. The mutations are preferably introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is preferably about 1-500 bases in length) in defined polynucleotide sequence to be mutagenized (wherein the sequence to be mutagenized is preferably from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

Defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligation Reassembly (SLR)

The invention provides a non-stochastic gene modification system termed "synthetic ligation reassembly," or simply "SLR," a "directed evolution process," to generate polypeptides, e.g., xylanases and/or glucanases, or antibodies of the invention, with new or altered properties.

SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. Pat. Nos. 6,773,900; 6,740,506; 6,713,282; 6,635,449; 6,605,449; 6,537,776. In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

Synthetic Gene Reassembly

In one aspect, the present invention provides a non-stochastic method termed synthetic gene reassembly (e.g., GeneReassembly, see, e.g., U.S. Pat. No. 6,537,776), which differs from stochastic shuffling in that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

In one aspect, synthetic gene reassembly comprises a method of: 1) preparing a progeny generation of molecule(s) (including a molecule comprising a polynucleotide sequence, e.g., a molecule comprising a polypeptide coding sequence), that is mutagenized to achieve at least one point mutation, addition, deletion, &/or chimerization, from one or more ancestral or parental generation template(s); 2) screening the progeny generation molecule(s), e.g., using a high throughput method, for at least one property of interest (such as an improvement in an enzyme activity); 3) in one aspect obtaining &/or cataloguing structural &/or and functional information regarding the parental &/or progeny generation molecules; and 4) in one aspect repeating any of steps 1) to 3). In one aspect, there is generated (e.g., from a parent polynucleotide template), in what is termed "codon site-saturation mutagenesis," a progeny generation of polynucleotides, each having at least one set of up to three contiguous point mutations (i.e. different bases comprising a new codon), such that every codon (or every family of degenerate codons encoding the same amino acid) is represented at each codon position. Corresponding to, and encoded by, this progeny generation of polynucleotides, there is also generated a set of progeny polypeptides, each having at least one single amino acid point mutation. In a one aspect, there is generated, in what is termed "amino acid site-saturation mutagenesis", one such mutant polypeptide for each of the 19 naturally encoded polypeptide-forming alpha-amino acid substitutions at each and every amino acid position along the polypeptide. This yields, for each and every amino acid position along the parental polypeptide, a total of 20 distinct progeny polypeptides including the original amino acid, or potentially more than 21 distinct progeny polypeptides if additional amino acids are used either instead of or in addition to the 20 naturally encoded amino acids Thus, in another aspect, this approach is also serviceable for generating mutants containing, in addition to &/or in combination with the 20 naturally encoded polypeptide-forming alpha-amino acids, other rare &/or not naturally-encoded amino acids and amino acid derivatives. In yet another aspect, this approach is also serviceable for generating mutants by the use of, in addition to &/or in combination with natural or unaltered codon recognition systems of suitable hosts, altered, mutagenized, &/or designer codon recognition systems (such as in a host cell with one or more altered tRNA molecules.

In yet another aspect, this invention relates to recombination and more specifically to a method for preparing polynucleotides encoding a polypeptide by a method of in vivo re-assortment of polynucleotide sequences containing regions of partial homology, assembling the polynucleotides to form at least one polynucleotide and screening the polynucleotides for the production of polypeptide(s) having a useful property.

In yet another aspect, this invention is serviceable for analyzing and cataloguing, with respect to any molecular property (e.g. an enzymatic activity) or combination of properties allowed by current technology, the effects of any mutational change achieved (including particularly saturation mutagenesis). Thus, a comprehensive method is provided for determining the effect of changing each amino acid in a parental polypeptide into each of at least 19 possible substitutions. This allows each amino acid in a parental polypeptide to be characterized and catalogued according to its spectrum of potential effects on a measurable property of the polypeptide.

In one aspect, an intron may be introduced into a chimeric progeny molecule by way of a nucleic acid building block. Introns often have consensus sequences at both termini in order to render them operational. In addition to enabling gene splicing, introns may serve an additional purpose by providing sites of homology to other nucleic acids to enable homologous recombination. For this purpose, and potentially others, it may be sometimes desirable to generate a large nucleic acid building block for introducing an intron. If the size is overly large easily generating by direct chemical synthesis of two single stranded oligos, such a specialized nucleic acid building block may also be generated by direct chemical synthesis of more than two single stranded oligos or by using a polymerase-based amplification reaction The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

Coupling can occur in a manner that does not make use of every nucleotide in a participating overhang. The coupling is particularly lively to survive (e.g. in a transformed host) if the coupling reinforced by treatment with a ligase enzyme to form what may be referred to as a "gap ligation" or a "gapped ligation". This type of coupling can contribute to generation of unwanted background product(s), but it can also be used advantageously increase the diversity of the progeny library generated by the designed ligation reassembly. Certain overhangs are able to undergo self-coupling to form a palindromic coupling. A coupling is strengthened substantially if it is reinforced by treatment with a ligase enzyme. Lack of 5' phosphates on these overhangs can be used advantageously to prevent this type of palindromic self-ligation. Accordingly, this invention provides that nucleic acid building blocks can be chemically made (or ordered) that lack a 5' phosphate group. Alternatively, they can be removed, e.g. by treatment with a phosphatase enzyme, such as a calf intestinal alkaline phosphatase (CIAP), in order to prevent palindromic self-ligations in ligation reassembly processes.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The xylanases and/or glucanases of the present invention can be mutagenized in accordance with the methods described herein.

Thus according to one aspect of the invention, the sequences of a plurality of progenitor nucleic acid templates (e.g., polynucleotides of The invention) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and preferably at almost all of the progenitor templates. Even more preferably still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated preferably comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g., one or more nucleotides, which may be, for example, codons or introns or regulatory sequences) that can later be in one aspect removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). Preferably, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In a one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which preferably has two ligatable ends. The two ligatable ends on each nucleic acid building block may be two blunt ends (i.e. each having an overhang of zero nucleotides), or preferably one blunt end and one overhang, or more preferably still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

In one aspect, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Exemplary sizes for building block range from 1 base pair (not including any overhangs) to 100,000 base pairs (not including any overhangs).

Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. The codon degeneracy can be introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., xylanases and/or glucanases, or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. See also U.S. Ser. No. 09/332,835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLAB™ (The Mathworks, Natick, Mass.) a programming language and development environment for technical computing.

Iterative Processes

In practicing the invention, these processes can be iteratively repeated. For example, a nucleic acid (or, the nucleic acid) responsible for an altered or new xylanase, mannanase and/or glucanase phenotype is identified, re-isolated, again modified, re-tested for activity. This process can be iteratively repeated until a desired phenotype is engineered. For example, an entire biochemical anabolic or catabolic pathway can be engineered into a cell, including, e.g., xylanase, mannanase and/or glucanase activity.

Similarly, if it is determined that a particular oligonucleotide has no affect at all on the desired trait (e.g., a new xylanase, mannanase and/or glucanase phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, xylanases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another aspect, the invention includes a method for producing a hybrid polynucleotide from at least a first polynucleotide and a second polynucleotide. The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:

a) Primers that include a poly-A head and poly-T tail which when made single-stranded would provide orientation can be utilized. This is accomplished by having the first few bases of the primers made from RNA and hence easily removed RNAseH.

b) Primers that include unique restriction cleavage sites can be utilized. Multiple sites, a battery of unique sequences and repeated synthesis and ligation steps would be required.

c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:

1) The use of vectors only stably maintained when the construct is reduced in complexity.
2) The physical recovery of shortened vectors by physical procedures. In this case, the cloning vector would be recovered using standard plasmid isolation procedures and size fractionated on either an agarose gel, or column with a low molecular weight cut off utilizing standard procedures.
3) The recovery of vectors containing interrupted genes which can be selected when insert size decreases.
4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

In one aspect (optionally), the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolarity of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N-3-Adenine (See Sun and Hurley, (1992); an N-acetylated or deacetylated 4'-fluoro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[a]anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ") and N-hydroxy-2-amino-1-methyl-6-phenylimidazo[4,5-f]-pyridine ("N-hydroxy-PhIP"). Exemplary means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., xylanase) sequences of the invention. The invention also provides additional methods for isolating xylanases using the nucleic acids and polypeptides of the invention. In one aspect, the invention provides for variants of a xylanase coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate new nucleic acids which encode polypeptides having characteristics which enhance their value in industrial, medical, laboratory (research), pharmaceutical, food and feed and food and feed supplement processing and other applications and processes. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/μl in a solution of 0.2 mM of each dNTP, 2.2 mM $MgCl_2$, 50 mMKCL, 10 mMTris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in Arkin, A. P. and Youvan, D. C., PNAS, USA, 89:7811-7815, 1992.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in Delegrave, S. and Youvan, D. C., Biotechnology Research, 11:1548-1552, 1993. Random and site-directed mutagenesis are described in Arnold, F. H., Current Opinion in Biotechnology, 4:450-455, 1993.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis.

The variants of the polypeptides of the invention may be variants in which one or more of the amino acid residues of the polypeptides of the invention are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of the polypeptides of the invention includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the invention and sequences substantially identical thereto. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying xylanase-encoding nucleic acids to modify codon usage. In one aspect, the invention provides methods for modifying codons in a nucleic acid encoding a xylanase to increase or decrease its expression in a host cell. The invention also provides nucleic acids encoding a xylanase modified to increase its expression in a host cell, xylanase so modified, and methods of making the modified xylanases. The method comprises identifying a "non-preferred" or a "less preferred" codon in xylanase-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli* and *Pseudomonas fluorescens*; gram positive bacteria, such as *Streptomyces diversa, Lactobacillus gasseri, Lactococcus lactis, Lactococcus cremoris, Bacillus subtilis*. Exemplary host cells also include eukaryotic organisms, e.g., various yeast, such as *Saccharomyces* sp., including *Saccharomyces cerevisiae, Schizosaccharomyces pombe, Pichia pastoris*, and *Kluyveromyces lactis, Hansenula polymorpha, Aspergillus niger*, and mammalian cells and cell lines and insect cells and cell lines. Thus, the invention also includes nucleic acids and polypeptides optimized for expression in these organisms and species.

For example, the codons of a nucleic acid encoding a xylanase isolated from a bacterial cell are modified such that the nucleic acid is optimally expressed in a bacterial cell different from the bacteria from which the xylanase was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., a xylanase), an expression cassette or vector or a transfected or transformed cell of the invention. The invention also provides methods of making and using these transgenic non-human animals.

The transgenic non-human animals can be, e.g., goats, rabbits, sheep, pigs, cows, rats, horses, dogs, fish and mice, comprising the nucleic acids of the invention. These animals can be used, e.g., as in vivo models to study xylanase activity, or, as models to screen for agents that change the xylanase activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs, chickens, goats, fish and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a xylanase of the invention, or, a fusion protein comprising a xylanase of the invention.

Transgenic Plants and Seeds

The invention provides transgenic plants and seeds comprising a nucleic acid, a polypeptide (e.g., a xylanase), an expression cassette or vector or a transfected or transformed cell of the invention. The invention also provides plant products or byproducts, e.g., fruits, oils, seeds, leaves, extracts and the like, including any plant part, comprising a nucleic acid and/or a polypeptide (e.g., a xylanase) of the invention, e.g., wherein the nucleic acid or polypeptide of the invention is heterologous to the plant, plant part, seed etc. The transgenic plant (which includes plant parts, fruits, seeds etc.) can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's xylanase production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of xylanase. The can change xylanase activity in a plant. Alternatively, a xylanase of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, in one aspect (optionally), marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327:70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot ¹/₁₀₀th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) Science 233:496-498; Fraley (1983) Proc. Nail. Acad. Sci. USA 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci. USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., a xylanase) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and *Zea*. Transgenic plants and seeds of the invention can be any monocot or dicot, e.g., a monocot corn, sugarcane, rice, wheat, barley, switchgrass or *Miscanthus*; or a dicot oilseed crop, soy, canola, rapeseed, flax, cotton, palm oil, sugar beet, peanut, tree, poplar or lupine.

In alternative embodiments, the nucleic acids of the invention are expressed in plants (and/or their seeds) which contain fiber cells, including, e.g., cotton, silk cotton tree (Kapok, Ceiba pentandra), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense*, and *G. hirsutum*.

The invention also provides for transgenic plants (and/or their seeds) to be used for producing large amounts of the polypeptides (e.g., a xylanase or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants (and/or their seeds) of the invention by detecting the increase or decrease of transgene mRNA or protein in transgenic plants. Means for detecting and quantitation of mRNAs or proteins are well known in the art.

Polypeptides and Peptides

In one aspect, the invention provides isolated, synthetic or recombinant polypeptides and peptides having xylanase, a mannanase and/or a glucanase activity, or polypeptides and peptides capable of generating an antibody that specifically binds to a xylanase or a glucanase, including an enzyme of this invention, including the amino acid sequences of the invention, which include those having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more, or 100% (complete) sequence identity to an exemplary polypeptide of the invention (as defined above), for example, the any of the exemplary sequences of the invention—which are all even sequences between SEQ ID NO:2 and SEQ ID NO:636 (see the sequence listing); and enzymatically active fragments thereof.

Various characteristics and properties of exemplary polypeptides of the invention are described and listed in Examples 13 to 15, below.

The invention also provides enzyme-encoding nucleic acids with a common novelty in that they encode a subset of xylanases, or a clade, comprising the "X14 module". In one aspect, the invention also provides enzyme-encoding nucleic acids with a common novelty in that they encode a clade comprising the "X14 module" (J. Bacteriol. 2002 August; 184(15): 4124-4133). X14-comprising xylanase members of this clade are listed in Table 9, below. Thus, in one aspect, the invention provides a novel genus of xylanases comprising xylanase members of the clade listed in Table 9, below, and related enzymes, for example, xylanases having a 50% or more sequence identity to an exemplary enzyme of the invention, as listed in Table 9, below. The sequences in the clade described in Table 9, below, are unique in that they all contain the CBM-like X14 module, which is remarkably similar across all xylanases in the described clade.

TABLE 9

| SEQ ID NOS: | X14 | unique clade |
|---|---|---|
| 169, 170 | y | y |
| 195, 196 | y | y |
| 215, 216 | y | y |
| 161, 162 | y | y |
| 225, 226 | y | y |
| 159, 160 | y | y |
| 299, 300 | y | y |
| 233, 234 | y | y |
| 181, 182 | y | y |
| 165, 166 | y | y |
| 217, 218 | y | y |
| 153, 154 | y | y |
| 219, 220 | y | y |
| 183, 184 | y | y |
| 253, 254 | y | y |
| 255, 256 | y | y |
| 221, 222 | y | y |
| 191, 192 | y | |
| 353, 354 | y | |
| 367, 368 | y | |
| 261, 262 | y | |
| 365, 366 | y | |
| 205, 206 | y | |
| 211, 212 | y | |

In one aspect, the invention provides chimeric enzymes, including xylanases, glucanases and/or glycosidases, having heterologous carbohydrate-binding modules (CBMs), e.g., for use in the processes of the invention and in various industrial, medical, pharmaceutical, research, food and feed and food and feed supplement processing and other applications. For example, in one aspect the invention provides enzymes, e.g., hydrolases, including glycosyl hydrolases (such as xylanases, glucanases) comprising one or more CBMs of an enzyme of the invention, including the CBM-like X14 module discussed above, as summarized in Table 9. In another aspect, CBMs, e.g., X14 modules, between different enzymes of the invention can be swapped; or, alternatively, one or more CBMs of one or more enzymes of the invention can be spliced into an enzyme, e.g., a hydrolase, e.g., any glycosyl hydrolase, such as a xylanase.

Glycosyl hydrolases that utilize insoluble substrates are modular, usually comprising catalytic modules appended to one or more non-catalytic carbohydrate-binding modules (CBMs). In nature, CBMs are thought to promote the interaction of the glycosyl hydrolase with its target substrate polysaccharide. For example, as discussed above, X14 is a xylan binding module. Thus, the invention provides chimeric enzymes having heterologous, non-natural substrates; including chimeric enzymes having multiple substrates by nature of their "spliced-in" heterologous CBMs, e.g., a spliced-in X14 module of the invention—thus giving the chimeric enzyme new specificity for xylan and galactan, or enhanced binding to xylan and galactan. The heterologous CBMs of the chimeric enzymes of the invention can be designed to be modular, i.e., to be appended to a catalytic module or catalytic domain (e.g., an active site), which also can be heterologous or can be homologous to the enzyme.

Utilization of just the catalytic module of a xylanase or a glucanase (e.g., an enzyme of the invention) has been shown to be effective. Thus, the invention provides peptides and polypeptides consisting of, or comprising, modular CBM/ active site modules (e.g., X14, see Table 9), which can be homologously paired or joined as chimeric (heterologous) active site-CBM pairs. Thus, these chimeric polypeptides/ peptides of the invention can be used to improve or alter the performance of an individual enzyme, e.g., a xylanase enzyme. A chimeric catalytic module of the invention (comprising, e.g., at least one CBM of the invention, e.g., X14) can be designed to target the enzyme to particular regions of a substrate, e.g., to particular regions of a pulp. For example, in one aspect, this is achieved by making fusions of the xylanase and various CBMs (either a xylanase of the invention with a heterologous CBM, or, a CBM of the invention with another enzyme, e.g., a hydrolase, such as a xylanase. For example, CBM4, CBM6, and CBM22 are known to bind xylan and may enhance the effectiveness of the xylanase in pulp biobleaching (see, e.g., Czjzek (2001) J. Biol. Chem. 276(51):48580-7, noting that CBM4, CBM6, and CBM22 are related and CBM interact primarily with xylan). In another embodiment, fusion of xylanase and CBM3a or CBM3b, which bind crystalline cellulose, may help the xylanase penetrate the complex polysaccharide matrix of pulp and reach inaccessible xylans. Any CBM can be used to practice the instant invention, e.g., as reviewed by Boraston (2004) Biochem. J. 382:769-781:

| Family | Protein | PDB code |
|---|---|---|
| CBM1 | Cellulase 7A (*Trichoderma reesei*) | 1CBH |
| CBM2 | Xylanase 10A (*Cellulomonas fimi*) | 1EXG |
| | Xylanase 11A (*Cellulomonas fimi*) | 2XBD |
| | Xylanase 11A (*Cellulomonas fimi*) | 1HEH |
| CBM3 | Scaffoldin (*Clostridium cellulolyticum*) | 1G43 |
| | Scaffoldin (*Clostridium thermocellum*) | 1NBC |
| | Cellulase 9A (*Thermobifida fusca*) | 1TF4 |
| CBM4 | Laminarinase 16A (*Thermotoga maritima*) | 1GUI |
| | Cellulase 9B (*Cellulomonas fimi*) | 1ULO; 1GU3 |
| | Cellulase 9B (*Cellulomonas fimi*) | 1CX1 |
| | Xylanase 10A (*Rhodothermus marinus*) | 1K45 |
| CBM5 | Cellulase 5A (*Erwinia chrysanthemi*) | 1AIW |
| | Chitinase B (*Serratia marcescens*) | 1E15 |
| CBM6 | Xylanase 11A (*Clostridium thermocellum*) | 1UXX |
| | Xylanase 11A (*Clostridium stercorarium*) | 1NAE |
| | Xylanase 11A (*Clostridium stercorarium*) | 1UY4 |
| | Endoglucanase 5A (*Cellvibrio mixtus*) | 1UZ0 |
| CBM9 | Xylanase 10A (*Thermotoga maritima*) | 1I8A |
| CBM10 | Xylanase 10A (*Cellvibrio japonicus*) | 1QLD |

-continued

| Family | Protein | PDB code |
|---|---|---|
| CBM12 | Chitinase Chi1 (*Bacillus circulans*) | 1ED7 |
| CBM13* | Xylanase 10A (*Streptomyces olivaceoviridis*) | 1XYF |
| | Xylanase 10A (*Streptomyces lividans*) | 1MC9 |
| | Ricin toxin B-chain (*Ricinus communis*) | 2AAI |
| | Abrin (*Abrus precatorius*) | 1ABR |
| CBM14 | Tachycitin (*Tachypleus tridentatus*) | 1DQC |
| CBM15 | Xylanase 10C (*Cellvibrio japonicus*) | 1GNY |
| CBM17 | Cellulase 5A (*Clostridium cellulovorans*) | 1J83 |
| CBM18* | Agglutinin (*Triticum aestivum*) | 1WGC |
| | Antimicrobial peptide (*Amaranthus caudatus*) | 1MMC |
| | Chitinase/agglutinin (*Urtica dioica*) | 1EIS |
| CBM20* | Glucoamylase (*Aspergillus niger*) | 1AC0 |
| | β-amylase (*Bacillus cereus*) | 1CQY |
| CBM22 | Xylanase 10B (*Clostridium thermocellum*) | 1DYO |
| CBM27 | Mannanase 5A (*Thermotoga maritima*) | 1OF4 |
| CBM28 | Cellulase 5A (*Bacillus* sp. 1139) | 1UWW |
| CBM29 | Non-catalytic protein 1 (*Pyromyces equi*) | 1GWK |
| CBM32 | Sialidase 33A (*Micromonospora viridifaciens*) | 1EUU |
| | Galactose oxidase (*Cladobotryum dendroides*) | 1GOF |
| CBM34* | α-Amylase 13A (*Thermoactinomyces vulgaris*) | 1UH2 |
| | Neopullulanase (*Geobacillus stearothermophilus*) | 1J0H |
| CBM36 | Xylanase 43A (*Paenibacillus polymyxa*) | 1UX7 |

*These families contain too many structure entries to list them all so only representatives are given.

Thus, the invention provides chimeric hydrolases, e.g., a fusion of a glycosidase with different (e.g., heterologous) CBMs to target the enzyme to particular insoluble polysaccharides to enhance performance in an application. In one aspect, the chimeric glycosidase comprises an enzyme of the invention. In one aspect, the chimeric enzyme comprises fusions of different CBMs to enhance pulp biobleaching performance, e.g., to achieve greater percentage reduction of bleaching chemicals. The invention also provides methods comprising recombining different CBMs with different xylanases (e.g., CBMs of the invention and/or xylanases of the invention) and screening the resultant chimerics to find the best combination for a particular application or substrate.

In one aspect, a polypeptide of the invention comprises a protein having a sequence as set forth in SEQ ID NO:382, where the signal sequence of the xylanase having a sequence as set forth in SEQ ID NO:160 (encoded by, e.g., SEQ ID NO:159) was removed (the removed signal sequence was MISLKRVAALLCVAGLGMSAAN), the "carbohydrate-binding module" (CBM) was removed, and a start methionine added. This truncated version is the xylanase of the invention having a sequence as set forth in SEQ ID NO:382 (encoded by, e.g., SEQ ID NO:381).

Three amino acid residues were then removed from the carboxy terminal end of the polypeptide SEQ ID NO:382, resulting in SEQ ID NO:384 (encoded by SEQ ID NO:383). One of these residues was a glutamate which when removed increased the pI of the protein. This deletion caused an increase in the enzyme's ability to brighten wood pulp at alkaline pH when compared to the wild type enzyme. In another aspect, three amino acid residues are removed from the carboxy terminal end of a GSSM variant of SEQ ID NO:382, e.g., polypeptide SEQ ID NO:482 (see below).

Thus, the invention provides a method for increasing performance of a xylanase, e.g., at high pH, by removal of the amino acid residues "EGG" (or the equivalent) near or at the C' terminal end of a xylanase sequence. In one aspect, the "EGG" (or the equivalent) is removed just (immediately) after the glycosyl hydrolase domain of the xylanase to be modified.

Other variations also are within the scope of this invention, e.g., where one, two, three, four or five or more residues are removed from the carboxy- or amino-terminal ends of any polypeptide of the invention. Another variation includes modifying any residue to increase or decrease pI of a polypeptide, e.g., removing or modifying (e.g., to another amino acid) a glutamate. This method was used as a general scheme for improving the enzyme's properties without creating regulatory issues since no amino acids are mutated; and this general scheme can be used with any polypeptide of the invention.

The polypeptide SEQ ID NO:384 was further evolved using GSSM, as is summarized in Table 11:

| Mutation | Nucleotide positions of the amino acid changed | Wild type (WT) Sequence | GSSM Sequence | Other codons also coding for same changed amino acid |
|---|---|---|---|---|
| T4L | 10-12 | ACC | CTT | TTA, TTG, CTC, CTA, CTG |
| S9P | 25-27 | AGT | CCC | CCG, CCA, CCT |
| Q10S | 28-30 | CAA | TCA | TCC, TCT, TCG, AGT, AGC |
| T13F | 37-39 | ACT | TTT | TTC |
| T13Y | 37-39 | ACT | TAC | TAT |
| T13I | 37-39 | ACT | ATA | ATT, ATC |
| T13W | 37-39 | ACT | TGG | — |
| N14H | 40-42 | AAC | CAC | CAT |
| Y18F | 52-54 | TAT | TTC | TTT |
| S25E | 73-75 | AGT | GAG | GAA |
| S25P | 73-75 | AGT | CCC | CCG, CCA, CCT |
| N30V | 88-90 | AAT | GTG | GTC, GTA, GTT |
| Q34C | 100-102 | CAG | TGT | TGC |

-continued

| Mutation | Nucleotide positions of the amino acid changed | Wild type (WT) Sequence | GSSM Sequence | Other codons also coding for same changed amino acid |
|---|---|---|---|---|
| Q34H | 100-102 | CAG | CAT | CAC |
| Q34L | 100-102 | CAG | TTG | TTA, CTT, CTC, CTA, CTG |
| S35E | 103-105 | TCC | GAG | GAA |
| S35D | 103-105 | TCC | GAT | GAC |
| S71T | 211-213 | TCA | ACA | ACT, ACC, ACG |
| S71C | 211-213 | TCA | TGT | TGC |
| S194H | 508-582 | AGT | CAT | CAC |

The polypeptide SEQ ID NO:384 was further evolved using GSSM to generate SEQ ID NO:482, encoded, e.g., by SEQ ID NO:481:

(SEQ ID NO:482)
MAQTCLTSPQTGFHNGFFYSFWKDSPGTVNFCLLEGGRYTSNWSGINNWV
GGKGWQTGSRRNITYSGSFNTPGNGYLALYGWTTNPLVEYYVVDSWGSRP
PGSDGTFLGTVNSDGGTYDIYRAQRVNAPSIIGNATFYQYWSVRQSKRVG
GTITTGNHFDAWASVGLNLGTHNYQIMATEGYQSSGSSDITVS (SEQ ID NO:481)
ATGGCCCAGACCTGCCTCACGTCGCCCCAAACCGGCTTTCACAATGGCTT
CTTCTATTCCTTCTGGAAGGACAGTCCGGGCACGGTGAATTTTTGCCTGT
TGGAGGGCGGCCGTTACACATCGAACTGGAGCGGCATCAACAACTGGGTG
GGCGGCAAGGGATGGCAGACCGGTTCACGCCGGAACATCACGTACTCGGG
CAGCTTCAATACACCGGGCAAGGGCTACCTGGCGCTTTACGGATGGACCA
CCAATCCACTCGTCGAGTACTACGTCGTCGATAGCTGGGGGAGCTGGCGT
CCGCCGGGTTCGGACGGAACGTTCCTGGGGACGGTCAACAGCGATGGCGG
AACGTATGACATCTATCGCGCGCAGCGGGTCAACGCGCCGTCCATCATCG
GCAACGCCACGTTCTATCAATACTGGAGCGTTCGGCAGTCGAAGCGGGTA
GGTGGGACGATCACCACCGGAAACCACTTCGACGCGTGGGCCAGCGTGGG
CCTGAACCTGGGCACTCACAACTACCAGATCATGGCGACCGAGGGCTACC
AAAGCAGCGGCAGCTCCGACATCACGGTGAGTTGA

Differences Between SEQ ID NO:382 and SEQ ID NO:482: First, three amino acids were removed from the C-terminus of SEQ ID NO:382. This was done in order to increase the pH performance of the enzyme. Second, seven amino acids were changed in order to increase the performance of the enzyme at high temperatures and at high pH. Thus the active SEQ ID NO:482 enzyme in the product comprises a slightly modified SEQ ID NO:382 catalytic domain.

Summary of Changes Made to the Exemplary Sequence SEQ ID NO:382

Figure 13:
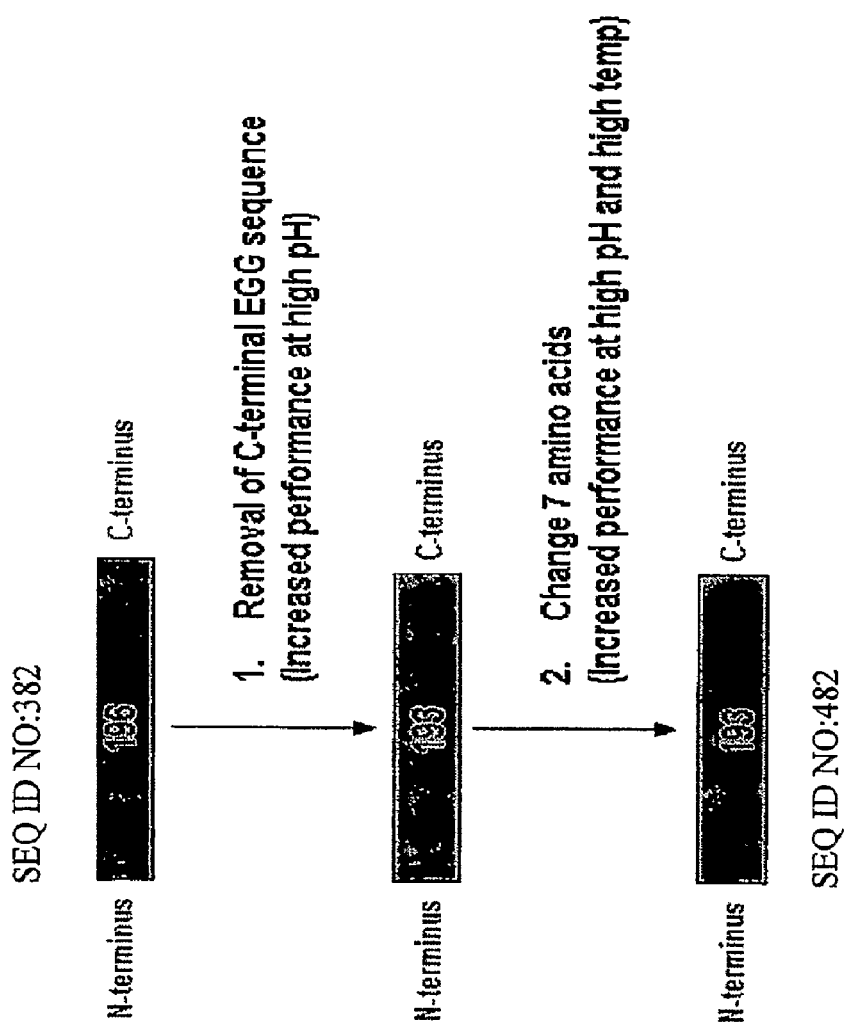
FIG. 13 illustrates a summary of changes made to the exemplary sequence SEQ ID NO:382 of the invention, as described in detail, below.

A summary of changes made to the exemplary sequence SEQ ID NO:382 of the invention are summarized in FIG. 13; wherein the figure illustrates removal of the C-terminal EGG sequence to give increased performance at high pH; followed by a change in seven (7) amino acid residues—this product having increased performance at high pH and high temperature; the final product has the sequence of SEQ ID NO:482.

Details of Amino Acid Changes Between SEQ ID NO:382 and SEQ ID NO:482:

| Amino Acid position | 9 | 13 | 14 | 18 | 34 | 35 | 71 |
|---|---|---|---|---|---|---|---|
| SEQ ID NO:382 | S | T | N | Y | Q | S | S |
| SEQ ID NO:482 | P | F | H | F | L | E | T |

Thus, the invention provides isolated, synthetic or recombinant polypeptides having xylanase activity, wherein the polypeptide has a sequence modification of any polypeptide of the invention, including any exemplary amino acid sequence of the invention (as defined above, including all even sequences between SEQ ID NO:2 to SEQ ID NO:636—see the sequence listing), wherein the sequence modification comprises at least one, two, three, four, five, six, seven, eight, nine, ten, eleven, twelve, thirteen, fourteen, fifteen, sixteen, seventeen, eighteen, nineteen or all of the following changes: the amino acid at the equivalent of the threonine at residue 4 of SEQ ID NO:384 is leucine, the amino acid at the equivalent of the serine at residue 9 of SEQ ID NO:384 is proline, the amino acid at the equivalent of the glutamine at residue 10 of SEQ ID NO:384 is serine, the amino acid at the equivalent of the threonine at residue 13 of SEQ ID NO:384 is phenylalanine, the amino acid at the equivalent of the threonine at residue 13 of SEQ ID NO:384 is tyrosine, the amino acid at the equivalent of the threonine at residue 13 of SEQ ID NO:384 is isoleucine, the amino acid at the equivalent of the threonine at residue 13 of SEQ ID NO:384 is tryptophan, the amino acid at the equivalent of the asparagine at residue 14 of SEQ ID NO:384 is histidine, the amino acid at the equivalent of the tyrosine at residue 18 of SEQ ID NO:384 is phenylalanine, the amino acid at the equivalent of the serine at residue 25 of SEQ ID NO:384 is glutamic acid, the amino acid at the equivalent of the serine at residue 25 of SEQ ID NO:384 is proline, the amino acid at the equivalent of the asparagine at residue 30 of SEQ ID NO:384 is valine, the amino acid at the equivalent of the glutamine at residue 34 of SEQ ID NO:384 is cysteine, the amino acid at the equivalent of the glutamine at residue 34 of SEQ ID NO:384 is histidine, the amino acid at the equivalent of the glutamine at residue 34 of SEQ ID NO:384 is leucine, the amino acid at the equivalent of the serine at residue 35 of SEQ ID NO:384 is glutamic acid, the amino acid at the equivalent of the serine at residue 35 of SEQ ID NO:384 is aspartic acid, the amino acid at the equivalent of the serine at residue 71 of SEQ ID NO:384 is threonine, the amino acid at the equivalent of the serine at residue 71 of SEQ ID NO:384 is cysteine, or the amino acid at the equivalent of the serine at residue 194 of SEQ ID NO:384 is histidine. The sequence change(s) can also comprise any amino acid modification to change the pI of a polypeptide, e.g., deletion or modification of a glutamate, or changing from a glutamate to another residue.

The invention also provides isolated, synthetic or recombinant polypeptides having xylanase activity, wherein the polypeptide has a sequence comprising one, two, three, four, five, six, seven, eight, nine, ten, eleven, twelve, thirteen, fourteen, fifteen, sixteen, seventeen, eighteen, nineteen or all of the following changes to the amino acid sequence of SEQ ID NO:384: the threonine at amino acid position 4 is leucine, the serine at amino acid position 9 is proline, the glutamine at amino acid position 10 is serine, the threonine at amino acid position 13 is phenylalanine, the threonine at amino acid position 13 is tyrosine, the threonine at amino acid position 13 is isoleucine, the threonine at amino acid position 13 is tryptophan, the asparagine at amino acid position 14 is histidine, the tyrosine at amino acid position 18 is phenylalanine, the serine at amino acid position 25 is glutamic acid, the serine at amino acid position 25 is proline, the asparagine at amino acid position 30 is valine, the glutamine at amino acid position 34 is cysteine, the glutamine at amino acid position 34 is histidine, the glutamine at amino acid position 34 is leucine, the serine at amino acid position 35 is glutamic acid, the serine at amino acid position 35 is aspartic acid, the serine at amino acid position 71 is threonine, the serine at amino acid position 71 is cysteine, or the serine at amino acid position 194 is histidine.

The invention further provides isolated, synthetic or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity) to an exemplary sequence of the invention.

In one aspect, the polypeptide has a xylanase or a glucanase activity; for example, wherein the xylanase activity can comprise hydrolyzing a glycosidic bond in a polysaccharide, e.g., a xylan. In one aspect, the polypeptide has a xylanase activity comprising catalyzing hydrolysis of internal β-1,4-xylosidic linkages. In one aspect, the xylanase activity comprises an endo-1,4-beta-xylanase activity. In one aspect, the xylanase activity comprises hydrolyzing a xylan to produce a smaller molecular weight xylose and xylo-oligomer. In one aspect, the xylan comprises an arabinoxylan, such as a water soluble arabinoxylan.

The invention provides polypeptides having glucanase activity, for example, the polypeptide having the sequence of SEQ ID NO:564, encoded e.g., by SEQ ID NO:563. In one aspect, the glucanase activity of a polypeptide or peptide of the invention (which includes a protein or peptide encoded by a nucleic acid of the invention) comprises an endoglucanase activity, e.g., endo-1,4- and/or 1,3-beta-D-glucan 4-glucano hydrolase activity. In one aspect, the endoglucanase activity comprises catalyzing hydrolysis of 1,4-beta-D-glycosidic linkages. In one aspect, the glucanase, e.g., endoglucanase, activity comprises an endo-1,4- and/or 1,3-beta-endoglucanase activity or endo-β-1,4-glucanase activity. In one aspect, the glucanase activity (e.g., endo-1,4-beta-D-glucan 4-glucano hydrolase activity) comprises hydrolysis of 1,4-beta-D-glycosidic linkages in cellulose, cellulose derivatives (e.g., carboxy methyl cellulose and hydroxy ethyl cellulose) lichenin, beta-1,4 bonds in mixed beta-1,3 glucans, such as cereal beta-D-glucans and other plant material containing cellulosic parts. In one aspect, the glucanase, xylanase, or mannanase activity comprises hydrolyzing a glucan or other polysaccharide to produce a smaller molecular weight polysaccharide or oligomer. In one aspect, the glucan comprises a beta-glucan, such as a water soluble beta-glucan.

The invention provides polypeptides having mannanase (e.g., endo-1,4-beta-D-mannanase) activity, for example, catalyzing the hydrolysis of a beta-1,4-mannan, e.g., an unsubstituted linear beta-1,4-mannan. Mannanase activity determination can be determined using any known methods, e.g., the Congo Red method, as described e.g., by Downie (1994) "A new assay for quantifying endo-beta-mannanase activity using Congo red dye. Phytochemistry, July 1994, vol. 36, no. 4, p. 829-835; or, as described in U.S. Pat. No. 6,060,299, e.g., by applying a solution to be tested to 4 mm diameter holes punched out in agar plates containing 0.2% AZCL galactomannan (carob) or any substrate for the assay of endo-1,4-beta-D-mannanase.

Any xylanase, glucanase and/or mannanase assay known in the art can be used to determine if a polypeptide has xylanase, glucanase and/or mannanase activity and is within scope of the invention. For example, reducing sugar assays such as the Nelson-Somogyi method or the dinitrosalicylic acid (DNS) method can be used to assay for the product sugars (and thus, xylanase activity). In one aspect, reactions are carried out by mixing and incubating a dilution of the enzyme preparation with a known amount of substrate at a buffered pH and set temperature. Xylanase assays are similar to cellulase assays except that a solution of xylan (e.g., oat spelts or birch) is substituted for CMC or filter paper. The DNS assay is easier to use than the Nelson-Somogyi assay. The DNS assay is satisfactory for cellulase activities, but tends to over estimate xylanase activity. The Somogyi-Nelson procedure is more accurate in the determination of reducing sugars, to measure specific activities and to quantify the total amount of xylanase produced in the optimized growth conditions, see, e.g., Breuil (1985) Comparison of the 3,5-dinitrosalicylic acid and Nelson-Somogyi methods of assaying for reducing sugars and determining cellulase activity, Enzyme Microb. Technol. 7:327-332; Somogyi, M. 1952, Notes on sugar determination, J. Biol. Chem. 195:19-23. The invention incorporates use of any reducing sugar assay, e.g., by Nelson-Somogyi, e.g., based on references Nelson, N. (1944) J. Biol. Chem. 153:375-380, and Somogyi, M. (1952) J. Biol. Chem. 195:19-23.

It has been demonstrated that the xylanase having a sequence as set forth in SEQ ID NO:182 (encoded by, e.g., SEQ ID NO:181) ("SEQ ID NO:181/182") and the xylanase having a sequence as set forth in SEQ ID NO:382 (encoded by, e.g., SEQ ID NO:381) ("SEQ ID NO:381/382") increase pulp brightness at pH 8 to a greater extent than other enzymes. The brightness increase is similar for both enzymes when they are dosed at an equal amount of units. These two top performers differ when assayed at pH 10 with SEQ ID NO:182 (encoded by, e.g., SEQ ID NO:181) ("SEQ ID NO:181/182") resulting in greater brightness levels than SEQ ID NO:381/382. SEQ ID NO:181/182 has a pI of 8.8 and SEQ ID NO:382 (encoded by, e.g., SEQ ID NO:381 has a pI of 7.9. SEQ ID NO:381/382 is 197 amino acids long. When E195, G196 and G194 are removed, resulting in SEQ ID NO:384 (encoded by SEQ ID NO:383), the pI becomes 8.5. This construct has better activity at high pH because the pI of the protein is closer to SEQ ID NO:181/182 in the truncated construct.

The three genes, SEQ ID NO:182 (encoded by, e.g., SEQ ID NO:181), SEQ ID NO:382 (encoded by, e.g., SEQ ID NO:381, and SEQ ID NO:384 (encoded by, e.g., SEQ ID NO:383, were expressed and the gene products were assayed using the Nelson-Somogyi reducing sugar assay determine U/mL of enzyme were a unit is the amount of enzyme that will release 1 µmole of xylose min$^{-1}$. The enzymes were dosed at 2 U/g of OD (oven dried) pulp and assayed according to the applications biobleaching protocol, described in Example 8, below.

Figure 12:
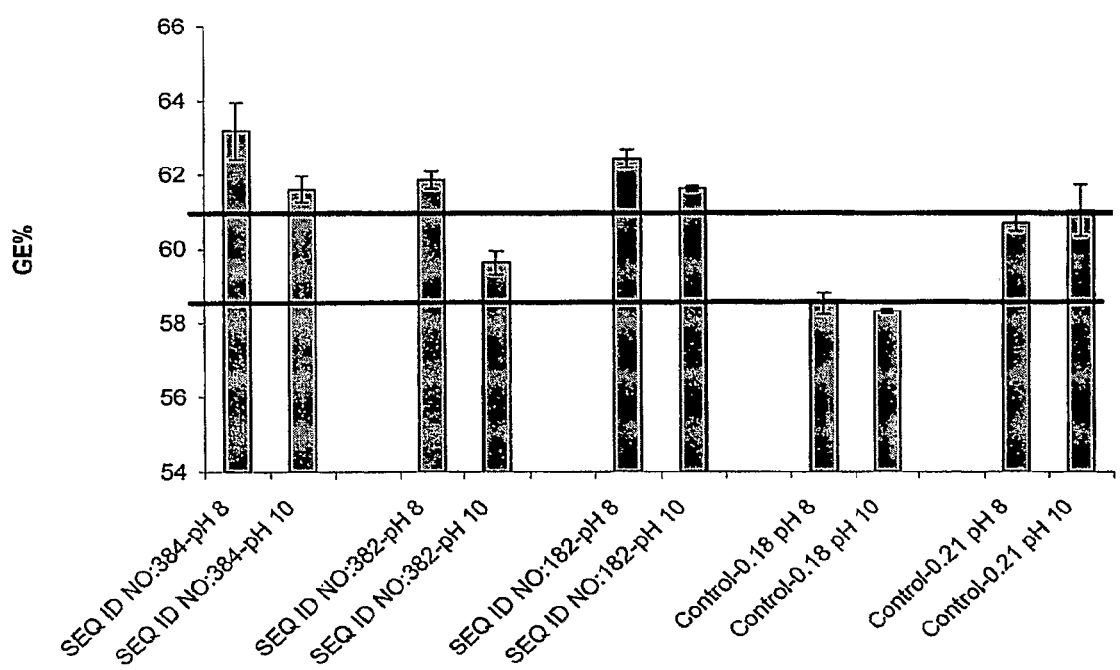
FIG. 12 graphically illustrates the results of a "biobleaching" study using exemplary xylanases of the invention, as described in detail, below.

The results of the "biobleaching" study, shown in FIG. 12 are: at pH=8: SEQ ID NO:382 and SEQ ID NO:182 performed better than control, C-0.21, as seen in the past; at pH=10: SEQ ID NO:382 performance dropped below control, C-0.21, as seen in the past; at pH=10, SEQ ID NO:182 performance did NOT drop below control, C-0.21, as seen in the past; SEQ ID NO:384 outperformed both SEQ ID NO:382 and SEQ ID NO:182 at pH=8; SEQ ID NO:384 performance at pH=10 did NOT drop below control, C-0.21 and was comparable to that of SEQ ID NO:182. These results indicate that the truncated SEQ ID NO:384 (encoded, e.g., by SEQ ID NO:383) performed as well as SEQ ID NO:182 (encoded, e.g., by SEQ ID NO:181) at pH 10 while SEQ ID NO:382 performed poorly under these conditions. Enzymes were used to treat SSWB at a Kappa Factor of 0.18. In FIG. 12, the black lines represent control brightness levels at 0.18 (lower line) and 0.21 (upper line). This "biobleaching" study demonstrates the use of gene truncation to improve the properties of xylanase enzymes. This "biobleaching" study also demonstrates that increased pI of a xylanase leads to increased performance of Southern Softwood Pine Brownstock (SSWB).

The polypeptides of the invention include xylanases in an active or inactive fomm. For example, the polypeptides of the invention include proproteins before "maturation" or processing of prepro sequences, e.g., by a proprotein-processing enzyme, such as a proprotein convertase to generate an "active" mature protein. The polypeptides of the invention include xylanases inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the xylanase.

Methods for identifying "prepro" domain sequences and signal sequences are well known in the art, see, e.g., Van de Ven (1993) Crit. Rev. Oncog. 4(2): 115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated, synthetic or recombinant signal sequences, prepro sequences and catalytic domains (e.g., "active sites") comprising sequences of the invention.

The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues. Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as a xylanase; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary xylanase of the invention.

Peptides of the invention (e.g., a subsequence of an exemplary polypeptide of the invention) can be useful as, e.g., labeling probes, antigens, toleragens, motifs, xylanase active sites (e.g., "catalytic domains"), signal sequences and/or prepro domains.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art Polypeptide and peptides of the invention can also be synthesized, whole or in part, using chemical methods well known in the art See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

"Amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques that are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphytidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, xylan hydrolase processing, phosphorylation, prenylation, racemization, selenoylation, sulfation and transfer-RNA mediated addition of amino acids to protein such as arginylation. (See Creighton, T. E., *Proteins—Structure and Molecular Properties 2nd Ed.*, W.H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

"Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., *Solid Phase Peptide Synthesis, 2nd Ed.*, Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl. Acad. Sci., USA*, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A automated peptide synthesizer. Such equipment provides ready access to the peptides of the invention, either by direct synthesis or by synthesis of a series of fragments that can be coupled using other known techniques.

"Fragments" as used herein are a portion of a naturally occurring protein which can exist in at least two different conformations. Fragments can have the same or substantially the same amino acid sequence as the naturally occurring protein. "Substantially the same" means that an amino acid sequence is largely, but not entirely, the same, but retains at least one functional activity of the sequence to which it is related. In general two amino acid sequences are "substantially the same" or "substantially homologous" if they are at least about 85% identical. Fragments which have different three dimensional structures as the naturally occurring protein are also included. An example of this, is a "pro-form" molecule, such as a low activity proprotein that can be modified by cleavage to produce a mature enzyme with significantly higher activity.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has a xylanase activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2, 3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluorophenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl)carbodiimide or 1-ethyl-3(4-azonia-4, 4-dimetholpentyl)carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzene-sulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The invention includes xylanases of the invention with and without signal. The polypeptide comprising a signal sequence of the invention can be a xylanase of the invention or another xylanase or another enzyme or other polypeptide.

The invention includes immobilized xylanases, anti-xylanase antibodies and fragments thereof. The invention provides methods for inhibiting xylanase activity, e.g., using dominant negative mutants or anti-xylanase antibodies of the invention. The invention includes heterocomplexes, e.g., fusion proteins, heterodimers, etc., comprising the xylanases of the invention.

Polypeptides of the invention can have a xylanase activity under various conditions, e.g., extremes in pH and/or temperature, oxidizing agents, and the like. The invention provides methods leading to alternative xylanase preparations with different catalytic efficiencies and stabilities, e.g., towards temperature, oxidizing agents and changing wash conditions. In one aspect, xylanase variants can be produced using techniques of site-directed mutagenesis and/or random mutagenesis. In one aspect, directed evolution can be used to produce a great variety of xylanase variants with alternative specificities and stability.

The proteins of the invention are also useful as research reagents to identify xylanase modulators, e.g., activators or inhibitors of xylanase activity. Briefly, test samples (compounds, broths, extracts, and the like) are added to xylanase assays to determine their ability to inhibit substrate cleavage. Inhibitors identified in this way can be used in industry and research to reduce or prevent undesired proteolysis. As with xylanases, inhibitors can be combined to increase the spectrum of activity.

The enzymes of the invention are also useful as research reagents to digest proteins or in protein sequencing. For example, the xylanases may be used to break polypeptides into smaller fragments for sequencing using, e.g. an automated sequencer.

The invention also provides methods of discovering new xylanases using the nucleic acids, polypeptides and antibodies of the invention. In one aspect, phagemid libraries are screened for expression-based discovery of xylanases. In another aspect, lambda phage libraries are screened for expression-based discovery of xylanases. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

Another aspect of the invention is an isolated or purified polypeptide comprising the sequence of one of the invention and sequences substantially identical thereto, or fragments comprising at least about 5, 10, 15, 20, 25, 30, 35, 40, 50, 75, 100, or 150 consecutive amino acids thereof. As discussed above, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for amplifying expression.

Another aspect of the invention is polypeptides or fragments thereof which have at least about 50%, at least about 55%, at least about 60%, at least about 65%, at least about 70%, at least about 75%, at least about 80%, at least about 85%, at least about 90%, at least about 95%, or more than about 95% homology to one of the polypeptides of the invention and sequences substantially identical thereto, or a fragment comprising at least 5, 10, 15, 20, 25, 30, 35, 40, 50, 75, 100, or 150 consecutive amino acids thereof. Homology may be determined using any of the programs described above which aligns the polypeptides or fragments being compared and determines the extent of amino acid identity or similarity between them. It will be appreciated that amino acid "homology" includes conservative amino acid substitutions such as those described above.

The polypeptides or fragments having homology to one of the polypeptides of the invention, or a fragment comprising at least about 5, 10, 15, 20, 25, 30, 35, 40, 50, 75, 100, or 150 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by xylan hydrolase digestion, gel electrophoresis and/or microsequencing. The sequence of the prospective homologous polypeptide or fragment can be compared to one of the polypeptides of the invention, or a fragment comprising at least about 5, 10, 15, 20, 25, 30, 35, 40, 50, 75, 100, or 150 consecutive amino acids thereof using any of the programs described above.

Another aspect of the invention is an assay for identifying fragments or variants of The invention, which retain the enzymatic function of the polypeptides of The invention. For example the fragments or variants of said polypeptides, may be used to catalyze biochemical reactions, which indicate that the fragment or variant retains the enzymatic activity of the polypeptides of the invention.

The assay for determining if fragments of variants retain the enzymatic activity of the polypeptides of the invention includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The polypeptides of the invention or fragments comprising at least 5, 10, 15, 20, 25, 30, 35, 40, 50, 75, 100, or 150 consecutive amino acids thereof may be used in a variety of applications. For example, the polypeptides or fragments thereof may be used to catalyze biochemical reactions. In accordance with one aspect of the invention, there is provided a process for utilizing the polypeptides of the invention or polynucleotides encoding such polypeptides for hydrolyzing glycosidic linkages. In such procedures, a substance containing a glycosidic linkage (e.g., a starch) is contacted with one of the polypeptides of The invention, or sequences substantially identical thereto under conditions which facilitate the hydrolysis of the glycosidic linkage.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is in one aspect (optionally) repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Xylanase Signal Sequences, Prepro and Catalytic Domains

The invention provides xylanase signal sequences (e.g., signal peptides (SPs)), prepro domains and catalytic domains (CDs). The SPs, prepro domains and/or CDs of the invention can be isolated, synthetic or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention). In one aspect, the invention provides a signal sequence comprising a peptide comprising/consisting of a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44, 1 to 45, 1 to 46, 1 to 47, 1 to 48, 1 to 49 or 1 to 50, of a polypeptide of the invention.

In one aspect, the invention provides a signal sequence comprising a peptide comprising/consisting of a sequence as set forth in Table 4, below. For example, in reading Table 4, the invention provides a signal sequence comprising/consisting of residues 1 to 23 of SEQ ID NO:102 (encoded, e.g., by SEQ ID NO:101), a signal sequence comprising/consisting of residues 1 to 41 of SEQ ID NO:104 (encoded, e.g., by SEQ ID NO:103), etc.

TABLE 4 exemplary signal sequences of the invention

| SEQ ID NO: | Signal sequence (amino acid positions) |
|---|---|
| 101, 102 | 1-23 |
| 103, 104 | 1-41 |
| 105, 106 | 1-22 |
| 109, 110 | 1-26 |
| 11, 12 | 1-28 |
| 113, 114 | 1-28 |
| 119, 120 | 1-33 |
| 121, 122 | 1-20 |
| 123, 124 | 1-20 |
| 131, 132 | 1-26 |
| 135, 136 | 1-25 |
| 139, 140 | 1-24 |
| 141, 142 | 1-25 |
| 143, 144 | 1-32 |
| 147, 148 | 1-28 |
| 149, 150 | 1-18 |
| 15, 16 | 1-20 |
| 151, 152 | 1-21 |
| 153, 154 | 1-16 |
| 155, 156 | 1-21 |
| 157, 158 | 1-29 |
| 159, 160 | 1-23 |
| 161, 162 | 1-32 |
| 163, 164 | 1-26 |
| 165, 166 | 1-23 |
| 167, 168 | 1-36 |
| 169, 170 | 1-24 |
| 17, 18 | 1-31 |
| 171, 172 | 1-29 |
| 173, 174 | 1-22 |
| 175, 176 | 1-27 |
| 177, 178 | 1-26 |
| 179, 180 | 1-19 |
| 181, 182 | 1-25 |
| 183, 184 | 1-32 |
| 185, 186 | 1-27 |
| 187, 188 | 1-28 |
| 19, 20 | 1-29 |
| 191, 192 | 1-27 |
| 193, 194 | 1-21 |
| 195, 196 | 1-23 |
| 197, 198 | 1-28 |
| 199, 200 | 1-30 |
| 203, 204 | 1-30 |
| 205, 206 | 1-29 |
| 207, 208 | 1-27 |
| 209, 210 | 1-25 |
| 21, 22 | 1-28 |
| 211, 212 | 1-29 |
| 215, 216 | 1-31 |
| 217, 218 | 1-29 |
| 219, 220 | 1-23 |
| 221, 222 | 1-24 |
| 223, 224 | 1-28 |
| 225, 226 | 1-25 |
| 227, 228 | 1-39 |
| 229, 230 | 1-28 |
| 23, 24 | 1-29 |
| 231, 232 | 1-41 |
| 233, 234 | 1-26 |
| 235, 236 | 1-28 |
| 237, 238 | 1-32 |
| 239, 240 | 1-30 |
| 241, 242 | 1-28 |

TABLE 4-continued exemplary signal sequences of the invention

| SEQ ID NO: | Signal sequence (amino acid positions) |
|---|---|
| 243, 244 | 1-33 |
| 245, 246 | 1-32 |
| 249, 250 | 1-33 |
| 253, 254 | 1-24 |
| 255, 256 | 1-51 |
| 259, 260 | 1-24 |
| 261, 262 | 1-26 |
| 263, 264 | 1-29 |
| 267, 268 | 1-30 |
| 27, 28 | 1-27 |
| 271, 272 | 1-22 |
| 273, 274 | 1-74 |
| 277, 278 | 1-19 |
| 279, 280 | 1-22 |
| 283, 284 | 1-28 |
| 287, 288 | 1-23 |
| 289, 290 | 1-22 |
| 295, 296 | 1-26 |
| 299, 300 | 1-24 |
| 301, 302 | 1-28 |
| 303, 304 | 1-74 |
| 305, 306 | 1-32 |
| 309, 310 | 1-20 |
| 311, 312 | 1-33 |
| 313, 314 | 1-22 |
| 315, 316 | 1-28 |
| 319, 320 | 1-27 |
| 325, 326 | 1-27 |
| 327, 328 | 1-29 |
| 329, 330 | 1-35 |
| 33, 34 | 1-23 |
| 331, 332 | 1-28 |
| 333, 334 | 1-30 |
| 335, 336 | 1-50 |
| 339, 340 | 1-23 |
| 341, 342 | 1-45 |
| 347, 348 | 1-20 |
| 349, 350 | 1-20 |
| 351, 352 | 1-73 |
| 353, 354 | 1-18 |
| 355, 356 | 1-21 |
| 357, 358 | 1-25 |
| 359, 360 | 1-31 |
| 361, 362 | 1-26 |
| 365, 366 | 1-65 |
| 367, 368 | 1-23 |
| 369, 370 | 1-27 |
| 39, 40 | 1-24 |
| 41, 42 | 1-37 |
| 45, 46 | 1-25 |
| 47, 48 | 1-26 |
| 5, 6 | 1-47 |
| 51, 52 | 1-30 |
| 53, 54 | 1-37 |
| 55, 56 | 1-24 |
| 57, 58 | 1-22 |
| 59, 60 | 1-21 |
| 63, 64 | 1-20 |
| 65, 66 | 1-22 |
| 67, 68 | 1-28 |
| 69, 70 | 1-25 |
| 7, 8 | 1-57 |
| 73, 74 | 1-21 |
| 75, 76 | 1-22 |
| 77, 78 | 1-27 |
| 79, 80 | 1-36 |
| 83, 84 | 1-30 |
| 87, 88 | 1-29 |
| 89, 90 | 1-40 |
| 9, 10 | 1-36 |
| 95, 96 | 1-24 |
| 99, 100 | 1-33 |

| SEQ ID NO: | Signal sequence (amino acid positions) | Signal Sequence | SOURCE |
|---|---|---|---|
| 385, 386 | 1-25 | ADLRRRRLLQAAATLPLLGWCSAQA | Environmental |
| 387, 388 | 1-28 | MLKVLRKPVLSGLSLALLLPVGITSVGA | Environmental |
| 389, 390 | 1-25 | MSVKPFWRQWILCFMVMFFSAQAAA | Environmental |
| 391, 392 | 1-22 | MMKGFRWCVMAMVVMMTNVRA | Environmental |
| 393, 394 | 1-36 | MVMEGKGLLMRRRSVSLLGLAGLLAVPLTVLPQAQA | Bacteria |
| 395, 396 | 1-30 | MKVFRNSIIRKSVVLFCAVLWILPAGLSLA | Environmental |
| 397, 398 | | | Environmental |
| 399, 400 | 1-28 | MTSGRNTCVCLLLIVLAIGLLSKPPASA | Environmental |
| 401, 402 | 1-26 | MLKVLRKPIISGLALALLLPAGAAGA | Environmental |
| 403, 404 | 1-34 | MSQLDLNLKLFRRVFFALVLTSIIASVLSASVAS | Environmental |
| 405, 406 | | | Environmental |
| 407, 408 | 1-26 | MAFSKDKASFTRRSAIAAGLAAGVSA | Environmental |
| 409, 410 | 1-19 | MKVTAAFAGLLATVLAAPA | Environmental |
| 411, 412 | 1-19 | MVAFTSLLAGFAAIAGVLS | Environmental |

-continued

| SEQ ID NO: | Signal sequence (amino acid positions) | Signal Sequence | SOURCE |
|---|---|---|---|
| 413, 414 | 1-34 | MKKRQGFIKKGLVLGVSLLLLALIMMSATSQTSA | Environmental |
| 415, 416 | 1-22 | MKGFRWCVLAVLMLAATNLRAA | Environmental |
| 417, 418 | 1-21 | MNVLRSGLVTMLLLAAFSVQA | Environmental |
| 419, 420 | 1-19 | MLVRLLIAMTVLFSAFAHA | Environmental |
| 421, 422 | 1-16 | MKANIIFCLLAPLVAA | Environmental |
| 423, 424 | 1-35 | MPTGLRAKPCLTRWLAASACALAPLLLGAPASALA | Environmental |
| 425, 426 | 1-23 | MLQTIALIFLALVILIALLISFR | Environmental |
| 427, 428 | | | Environmental |
| 429, 430 | 1-21 | MNVLRSGIVTMLLLAAFSVQA | Environmental |
| 431, 432 | 1-19 | MVQIKAAALAVLFASNVLS | Environmental |
| 433, 434 | 1-39 | MNTLLPRRRLWSSTAILRTLAAGALAAGMVLAPVSAANA | Environmental *Cochilobolus heterostrophus* |
| 435, 436 | | | ATCC 48331 |
| 437, 438 | 1-23 | MRKPACATLAVMMSLLFTPFSQA | Environmental |
| 439, 440 | | | Environmental |
| 441, 442 | | | Environmental |
| 443, 444 | | | Environmental |
| 445, 446 | 1-21 | MKNIILNLSPVVFALLILTAA | Environmental |
| 447, 448 | 1-22 | MNALRTGAILVLMLAAAQVSAA | Environmental |
| 449, 450 | 1-22 | MMKAFRWCVIALMLAAAPLRAA | Environmental |
| 451, 452 | | | Environmental *Cochllobolus heterostrophus* |
| 453, 454 | | | ATCC 48332 |
| 455, 456 | | | Bacteria |
| 457, 458 | | | Environmental *Cochliobolus heterostrophus* |
| 459, 460 | | | ATCC 48333 |
| 461, 462 | 1-22 | MWQRSKTLVLVLGLLLSHQAFA | Environmental |
| 463, 464 | | | Environmental |
| 465, 466 | | | Environmental |
| 467, 468 | 1-16 | MKFFTVLLFFLSFVFS | Bacteria |
| 469, 470 | | | Environmental |
| 471, 472 | 1-21 | MRIHWLGLSSRASLMTAALLA | Environmental |
| 473, 474 | | | Environmental |
| 475, 476 | 1-28 | MKTHSFNLRSRITLLTAALLFIGATAGA | Environmental |
| 477, 478 | 1-29 | MKRFLSWSLTGILVASALVALALPGSSQA | Environmental |
| 479, 480 | 1-16 | MKVFATLAGLLATALA | Environmental |
| 483, 484 | 1-33 | MKKRLLALIVTLVFIISLFNPIFTTPLTNVAKA | |

| SEQ ID NO: | Signal sequence (amino acid positions) | Signal Sequence | SOURCE |
|---|---|---|---|
| 485, 486 | | | |
| 487, 488 | 1-23 | MQTVLLTVSLVFLASCMMATTNS | |
| 489, 490 | 1-18 | MKPILRSSLSCLGILVLA | |
| 491, 492 | 1-65 | MNNYRAFVLGLCWLGGLMLTGCGADQGSPDPGTSSATSSTS SSSEGFSSAVSESSASAISSSASS | |
| 493, 494 | 1-23 | MHVLAKICLVVLIALSTCASTMA | |
| 495, 496 | 1-23 | MRTRVLTLLGGFLGSTIAASVTV | |
| 497, 498 | | | |
| 499, 500 | 1-26 | MITFRNTLFTVVILAIVGSGLPACEA | |
| 501, 502 | 1-24 | MKYSHVVTLSLALVLCIAGLGVSA | |
| 503, 504 | 1-37 | MNTTQTTSKKSSRKRFAYTAFVVLISALTIFVSTALA | |
| 505, 506 | 1-28 | MRLKPTLKWAVSLLVTTAAMTFTSAVNA | |
| 507, 508 | 1-29 | MLTAKRSRPWVWSLLVTASALLLSAAAHS | |
| 509, 510 | | | |
| 511, 512 | 1-27 | MKFSHIRSLSLALVLCFTGFGVSTVHA | |
| 513, 514 | 1-27 | MRSKRMMFFFIMLVSFALALPAVNVSA | |
| 515, 516 | 1-28 | MLHILRKPIIAGLALSLVFSGGMGSVSA | |
| 517, 518 | 1-31 | MSFFKTITRNSKTCMTLALAATVSAVSANA | |
| 519, 520 | 1-33 | MSFASVKNITIAGKGLVALFTFALLSGISSVNA | |
| 521, 522 | 1-28 | MSFSRRRFILSATAMLAATQLKSRALAA | |
| 523, 524 | 1-29 | MNLKNKLTLKSSIAAAACVAAMSFSTANA | |
| 525, 526 | 1-28 | MNNSKDFFYKARGFLSALLLLVPIAAHA | |
| 527, 528 | 1-30 | MTAISRRKFLLSSAGALALAQMKVSAIAKA | |
| 529, 530 | 1-34 | MKHNVFSTRALRRVLPGGLLIAGLIGATATGLQA | |
| 531, 532 | 1-29 | MKLTNKITLKGSLAAAACVAAMGFSTANA | |
| 533, 534 | | | |
| 535, 536 | | | |
| 537, 538 | 1-29 | MPSRRQFLLGSAQVTGLMMLAKHQAIASA | |
| 539, 540 | 1-28 | MKTLLKITLSTLFAFIVLMGCDMGLRDA | |
| 541, 542 | 1-27 | MKRKSVKLFLAILFCILLILPAGMVSA | |
| 543, 544 | | | |
| 545, 546 | 1-24 | MNKTFRLPIILMGILLTFSSARCS | |
| 547, 548 | 1-20 | MTRLSRRNFLVGSAAVAAMA | |
| 549, 550 | | | |
| 551, 552 | | | |
| 553, 554 | 1-35 | MTGISTGRGKNPGRIYTTLSTALVFVVMGALESWA | |
| 555, 556 | 1-27 | MKFSHIRSLSLALVLCFTGFGVSTVHA | |

-continued

| SEQ ID NO: | Signal sequence (amino acid positions) | Signal Sequence | SOURCE |
|---|---|---|---|
| 557, 558 | 1-27 | MSSLIAGTIACCMMMMPLILAPSQVHA | |
| 559, 560 | | | |
| 561, 562 | 1-35 | MSLSKHKSLLLAVSRYTCAALLAGSLVACGGNTTT | |
| 563, 564 | 1-20 | MQSLFLFLVVFFFTQTQVFG | |
| 565, 566 | 1-60 | MNSYRALMLGLLGGLILTGCGAGQDSPTPGSSSAISSSSES FSSVTSESSSSAISSTASS | |
| 567, 568 | 1-28 | MTFSRRNFIWGTAAVLAATQLKARALAA | |
| 569, 570 | | | |
| 571, 572 | 1-25 | MNNSIKIVLGLIVLVFLLPACSGNS | |
| 573, 574 | | | |
| 575, 576 | | | |
| 577, 578 | 1-29 | MFMLSKKILMVLLTISMSFISLFTVTAYA | |
| 579, 580 | | | |
| 581, 582 | 1-23 | MSIRNFFTATVILVALGASLTWG | |
| 583, 584 | 1-27 | MVKLKLKLKNLLLVISILTLIGNNVFS | |
| 585, 586 | | | |
| 587, 588 | | | |
| 589, 590 | 1-29 | MKKRITSIAIVFALVFGFGVLGCSSNKQG | |
| 591, 592 | 1-39 | MLKQIGDQTVNLPLNKLTLKSSLTMACVMMSFSTANA | |
| 593, 594 | 1-29 | MNLLSTLPIKRSLTAAACIAAMGFSAANA | |
| 595, 596 | 1-31 | MVRSDTRRTRRFALLAVGAMLAGLMLPAAA | |
| 597, 598 | 1-31 | MVRSDTTRTRRFALLWSAMVAGMAVLPAAA | |
| 599, 600 | 1-29 | MGRQLKKIISMVLAFALLIPMMPITAAAA | |
| 601, 602 | 1-23 | MENKKFVRAIFLITTACCLSANA | |
| 603, 604 | 1-30 | MKKILKKLKETSVLHFWIASIFLSSCGNA | |
| 605, 606 | 1-30 | MTFSRRQFLLQTSAGLALLSTAKMRAFARA | |
| 607, 608 | 1-33 | MSFASVKNITTAGKGLVALFTFALLFGTSSVNA | |
| 609, 610 | 1-31 | MTISRRKFMWGTAALLAATQLKTRALAAAMA | |
| 611, 612 | | | |
| 613, 614 | 1-30 | MTFSRRQFLLQTSAGLALLSTAKMRAFARA | |
| 615, 616 | 1-27 | MIKRAIFLMTAVLLFSLAFLLPPPAGA | |
| 617, 618 | 1-20 | MRTFILIPLMLLVLSACTNG | |
| 619, 620 | | | |
| 621, 622 | 1-22 | MQLRRFTGGALIMVLCASAAKG | |
| 623, 624 | 1-41 | MHIVKSSAYLLLASVSLALSACSSSSSSGSETSSSSSASSSS | |
| 625, 626 | 1-30 | MNPLINRLALKSSLAAATCVAAMSFSTANA | |
| 627, 628 | 1-24 | MWKKFKVSLAYVLISVLLVSQGWA | |

| SEQ ID NO: | Signal sequence (amino acid positions) | Signal Sequence | SOURCE |
|---|---|---|---|
| 629, 630 | 1-27 | MHSRRKFLLRSAQATGLMLFAKQQAFA | |
| 631, 632 | 1-26 | MNNLSRRKFLLGSAGLAALTNLKACA | |
| 633, 634 | 1-20 | MRKLLIIWIVLILALLPVIS | |
| 635, 636 | 1-30 | MNPLINRLALKSSLAAATCVAAMSFSTANA | |

The xylanase signal sequences (SPs) and/or prepro sequences of the invention can be isolated peptides, or, sequences joined to another xylanase or a non-xylanase polypeptide, e.g., as a fusion (chimeric) protein. In one aspect, the invention provides polypeptides comprising xylanase signal sequences of the invention. In one aspect, polypeptides comprising xylanase signal sequences SPs and/or prepro of the invention comprise sequences heterologous to a xylanase of the invention (e.g., a fusion protein comprising an SP and/or prepro of the invention and sequences from another xylanase or a non-xylanase protein). In one aspect, the invention provides xylanases of the invention with heterologous SPs and/or prepro sequences, e.g., sequences with a yeast signal sequence. A xylanase of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel xylanase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The signal sequences can vary in length from between about 11 to 41, or between about 13 to 36 amino acid residues. Various methods of recognition of signal sequences are known to those of skill in the art. For example, in one aspect, novel xylanase signal peptides are identified by a method referred to as SignalP. SignalP uses a combined neural network which recognizes both signal peptides and their cleavage sites; see, e.g., Nielsen (1997) "Identification of prokaryotic and eukaryotic signal peptides and prediction of their cleavage sites." Protein Engineering 10:1-6.

It should be understood that in some aspects xylanases of the invention may not have SPs and/or prepro sequences, or "domains." In one aspect, the invention provides the xylanases of the invention lacking all or part of an SP and/or a prepro domain. In one aspect, the invention provides a nucleic acid sequence encoding a signal sequence (SP) and/or prepro from one xylanase operably linked to a nucleic acid sequence of a different xylanase or, in one aspect (optionally), a signal sequence (SPs) and/or prepro domain from a non-xylanase protein may be desired.

The invention also provides isolated, synthetic or recombinant polypeptides comprising signal sequences (SPs), prepro domain and/or catalytic domains (CDs) of the invention and heterologous sequences. The heterologous sequences are sequences not naturally associated (e.g., to a xylanase) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated, synthetic or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., a xylanase sequence). Similarly in one aspect, the invention provides isolated, synthetic or recombinant nucleic acids encoding these polypeptides. Thus, in one aspect, the isolated, synthetic or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Xylanases and Peptide Libraries

In one aspect, the invention provides hybrid xylanases and fusion proteins, including peptide libraries, comprising sequences of the invention. The peptide libraries of the invention can be used to isolate peptide modulators (e.g., activators or inhibitors) of targets, such as xylanase substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of xylanases of the invention and other peptides, including known and random peptides. They can be fused in such a manner that the structure of the xylanases is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of a xylanase sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed xylanase variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of xylan hydrolysis. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides xylanases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. xylanase activity) although variants can be selected to modify the characteristics of the xylanases as needed.

In one aspect, xylanases of the invention comprise epitopes or purification tags, signal sequences or other fusion sequences, etc. In one aspect, the xylanases of the invention can be fused to a random peptide to form a fusion polypeptide. By "fused" or "operably linked" herein is meant that the random peptide and the xylanase are linked together, in such a manner as to minimize the disruption to the stability of the xylanase structure, e.g., it retains xylanase activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Xylanases are multidomain enzymes that consist in one aspect (optionally) of a signal peptide, a carbohydrate binding module, a xylanase catalytic domain, a linker and/or another catalytic domain.

The invention provides a means for generating chimeric polypeptides which may encode biologically active hybrid polypeptides (e.g., hybrid xylanases). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

Enzymes encoded by the polynucleotides of the invention include, but are not limited to, hydrolases, such as xylanases. Glycosidase hydrolases were first classified into families in 1991, see, e.g., Henrissat (1991) Biochem. J. 280:309-316. Since then, the classifications have been continually updated, see, e.g., Henrissat (1993) Biochem. J. 293:781-788; Henrissat (1996) Biochem. J. 316:695-696; Henrissat (2000) Plant Physiology 124:1515-1519. There are 87 identified families of glycosidase hydrolases. In one aspect, the xylanases of the invention may be categorized in families 8, 10, 11, 26 and 30. In one aspect, the invention also provides xylanase-encoding nucleic acids with a common novelty in that they are derived from a common family, e.g., family 5, 6, 8, 10, 11, 26 or 30, as set forth in Table 5, below.

TABLE 5

| SEQ ID | FAMILY |
|---|---|
| 9, 10 | 8 |
| 1, 2 | 8 |
| 5, 6 | 8 |
| 7, 8 | 8 |

TABLE 5-continued

| SEQ ID | FAMILY |
|---|---|
| 99, 100 | 10 |
| 11, 12 | 10 |
| 127, 128 | 10 |
| 27, 28 | 10 |
| 97, 98 | 10 |
| 45, 46 | 10 |
| 141, 142 | 10 |
| 107, 108 | 10 |
| 129, 130 | 10 |
| 93, 94 | 10 |
| 63, 64 | 10 |
| 25, 26 | 10 |
| 49, 50 | 10 |
| 67, 68 | 10 |
| 85, 86 | 10 |
| 29, 30 | 10 |
| 51, 52 | 10 |
| 35, 36 | 10 |
| 147, 148 | 10 |
| 119, 120 | 10 |
| 123, 124 | 10 |
| 249, 250 | 10 |
| 149, 150 | 10 |
| 83, 84 | 10 |
| 43, 44 | 10 |
| 133, 134 | 10 |
| 113, 114 | 10 |
| 105, 106 | 10 |
| 75, 76 | 10 |
| 111, 112 | 10 |
| 117, 118 | 10 |
| 115, 116 | 10 |
| 125, 126 | 10 |
| 137, 138 | 10 |
| 135, 136 | 10 |
| 69, 70 | 10 |
| 89, 90 | 10 |
| 31, 32 | 10 |
| 13, 14 | 10 |
| 65, 66 | 10 |
| 57, 58 | 10 |
| 77, 78 | 10 |
| 73, 74 | 10 |
| 109, 110 | 10 |
| 59, 60 | 10 |
| 71, 72 | 10 |
| 139, 140 | 10 |
| 55, 56 | 10 |
| 15, 16 | 10 |
| 131, 132 | 10 |
| 95, 96 | 10 |
| 101, 102 | 10 |
| 39, 40 | 10 |
| 143, 144 | 10 |
| 103, 104 | 10 |
| 17, 18 | 10 |
| 53, 54 | 10 |
| 21, 22 | 10 |
| 151, 152 | 10 |
| 23, 24 | 10 |
| 121, 122 | 10 |
| 41, 42 | 10 |
| 47, 48 | 10 |
| 247, 248 | 10 |
| 33, 34 | 10 |
| 19, 20 | 10 |
| 87, 88 | 10 |
| 81, 82 | 10 |
| 91, 92 | 10 |
| 61, 62 | 10 |
| 37, 38 | 10 |
| 79, 80 | 10 |
| 231, 232 | 11 |
| 157, 158 | 11 |
| 189, 190 | 11 |
| 167, 168 | 11 |
| 207, 208 | 11 |
| 251, 252 | 11 |
| 213, 214 | 11 |
| 177, 178 | 11 |
| 187, 188 | 11 |
| 205, 206 | 11 |
| 211, 212 | 11 |
| 197, 198 | 11 |
| 209, 210 | 11 |
| 185, 186 | 11 |
| 229, 230 | 11 |
| 223, 224 | 11 |
| 179, 180 | 11 |
| 193, 194 | 11 |
| 173, 174 | 11 |
| 217, 218 | 11 |
| 153, 154 | 11 |
| 219, 220 | 11 |
| 183, 184 | 11 |
| 253, 254 | 11 |
| 199, 200 | 11 |
| 255, 256 | 11 |
| 155, 156 | 11 |
| 169, 170 | 11 |
| 195, 196 | 11 |
| 215, 216 | 11 |
| 191, 192 | 11 |
| 175, 176 | 11 |
| 161, 162 | 11 |
| 221, 222 | 11 |
| 225, 226 | 11 |
| 163, 164 | 11 |
| 159, 160 | 11 |
| 233, 234 | 11 |
| 171, 172 | 11 |
| 203, 204 | 11 |
| 181, 182 | 11 |
| 227, 228 | 11 |
| 165, 166 | 11 |
| 257, 258 | 26 |
| 237, 238 | 30 |
| 241, 242 | 30 |
| 239, 240 | 30 |
| 245, 246 | 30 |
| 235, 236 | 30 |
| 313, 314 | 30 |
| 345, 346 | 10 |
| 321, 322 | 10 |
| 323, 324 | 10 |
| 315, 316 | 10 |
| 201, 202 | 10 |
| 265, 266 | 10 |
| 145, 146 | 10 |
| 287, 288 | 10 |
| 293, 294 | 10 |
| 351, 352 | 10 |
| 311, 312 | 10 |
| 279, 280 | 10 |
| 289, 290 | 10 |
| 283, 284 | 10 |
| 373, 374 | 10 |
| 337, 338 | 10 |
| 371, 372 | 10 |
| 291, 292 | 10 |
| 3, 4 | 10 |
| 307, 308 | 10 |
| 343, 344 | 10 |
| 349, 350 | 10 |
| 329, 330 | 10 |
| 355, 356 | 10 |
| 339, 340 | 10 |
| 295, 296 | 10 |
| 333, 334 | 10 |
| 281, 282 | 10 |
| 361, 362 | 10 |
| 347, 348 | 10 |
| 319, 320 | 10 |
| 357, 358 | 10 |
| 365, 366 | 10 |
| 273, 274 | 10 |

TABLE 5-continued

| SEQ ID | FAMILY |
|---|---|
| 277, 278 | 10 |
| 271, 272 | 10 |
| 285, 286 | 10 |
| 259, 260 | 10 |
| 325, 326 | 10 |
| 331, 332 | 10 |
| 359, 360 | 10 |
| 303, 304 | 10 |
| 363, 364 | 10 |
| 305, 306 | 10 |
| 341, 342 | 10 |
| 375, 376 | 11 |
| 377, 378 | 11 |
| 379, 380 | 11 |
| 301, 302 | 11 |
| 309, 310 | 11 |
| 263, 264 | 11 |
| 269, 270 | 11 |
| 353, 354 | 11 |
| 299, 300 | 11 |
| 367, 368 | 11 |
| 261, 262 | 11 |
| 369, 370 | 11 |
| 267, 268 | 11 |
| 317, 318 | 11 |
| 297, 298 | 11 |
| 327, 328 | 5 |
| 275, 276 | 6 |

A hybrid polypeptide resulting from the method of the invention may exhibit specialized enzyme activity not displayed in the original enzymes. For example, following recombination and/or reductive reassortment of polynucleotides encoding hydrolase activities, the resulting hybrid polypeptide encoded by a hybrid polynucleotide can be screened for specialized hydrolase activities obtained from each of the original enzymes, i.e. the type of bond on which the hydrolase acts and the temperature at which the hydrolase functions. Thus, for example, the hydrolase may be screened to ascertain those chemical functionalities which distinguish the hybrid hydrolase from the original hydrolases, such as: (a) amide (peptide bonds), i.e., xylanases; (b) ester bonds, i.e., esterases and lipases; (c) acetals, i.e., glycosidases and, for example, the temperature, pH or salt concentration at which the hybrid polypeptide functions.

Sources of the original polynucleotides may be isolated from individual organisms ("isolates"), collections of organisms that have been grown in defined media ("enrichment cultures"), or, uncultivated organisms ("environmental samples"). The use of a culture-independent approach to derive polynucleotides encoding novel bioactivities from environmental samples is most preferable since it allows one to access untapped resources of biodiversity.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

Additionally, subcloning may be performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al., *Molecular Cloning: A Laboratory Manual 2nd Ed.*, Cold Spring Harbor Laboratory Press (1989)). In another aspect, the enzymes of the invention are subclones. Such subclones may differ from the parent clone by, for example, length, a mutation, a tag or a label.

It should be understood that some of the xylanases of the invention may or may not contain signal sequences. It may be desirable to include a nucleic acid sequence encoding a signal sequence from one xylanase operably linked to a nucleic acid sequence of a different xylanase or, in one aspect (optionally), a signal sequence from a non-xylanase protein may be desired.

The microorganisms from which the polynucleotide may be prepared include prokaryotic microorganisms, such as *Eubacteria* and *Archaebacteria* and lower eukaryotic microorganisms such as fungi, some algae and protozoa. Polynucleotides may be isolated from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several esterases and lipases cloned and expressed from extremophilic organisms show high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are preferably already in a vector which includes appropriate control sequences. The host cell can be a higher eukaryotic cell, such as a mammalian cell, or a lower eukaryotic cell, such as a yeast cell, or preferably, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as *E. coli, Streptomyces, Salmonella typhimurium*; fungal cells, such as yeast; insect cells such as *Drosophila* S2 and *Spodoptera* Sf9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors will comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of *E. coli*. This f-factor of *E. coli* is a plasmid which affects high-frequency transfer of itself during conjugation and is ideal to achieve and stably propagate large DNA fragments, such as gene clusters from mixed microbial samples. One aspect of the invention is to use cloning vectors, referred to as "fosmids" or bacterial artificial chromosome (BAC) vectors. These are derived from *E. coli* f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., *Molecular Cloning: A Laboratory Manual, 2nd Ed.*, Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Therefore, in a one aspect, the invention relates to a method for producing a biologically active hybrid polypeptide and screening such a polypeptide for enhanced activity by:
1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and
5) isolating the a polynucleotide encoding the hybrid polypeptide.

Methods for screening for various enzyme activities are known to those of skill in the art and are discussed throughout the present specification. Such methods may be employed when isolating the polypeptides and polynucleotides of the invention.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for xylanase activity (e.g., assays such as hydrolysis of casein in zymograms, the release of fluorescence from gelatin, or the release of p-nitroanalide from various small peptide substrates), to screen compounds as potential modulators, e.g., activators or inhibitors, of a xylanase activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application No. 20020001809.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids and/or polypeptides of the invention can be immobilized to or applied to an array, e.g., a "biochip". Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a xylanase gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated, synthetic or recombinant antibodies that specifically bind to a xylanase of the invention. These antibodies can be used to isolate, identify or quantify the xylanases of the invention or related polypeptides. These antibodies can be used to isolate other polypeptides within the scope the invention or other related xylanases. The antibodies can be designed to bind to an active site of a xylanase. Thus, the invention provides methods of inhibiting xylanases using the antibodies of the invention (see discussion above regarding applications for anti-xylanase compositions of the invention).

The invention provides fragments of the enzymes of the invention, including immunogenic fragments of a polypeptide of the invention. The invention provides compositions comprising a polypeptide or peptide of the invention and adjuvants or carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, N.Y. (1991); Stites (eds.) BASIC AND CLINICAL IMMUNOLOGY (7th ed.) Lange Medical Publications, Los Altos, Calif. ("Stites"); Coding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of The invention or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of The invention, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of The invention, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of The invention, or fragments comprising at least 5, 10, 15, 20, 25, 30, 35, 40, 50, 75, 100, or 150 or more consecutive amino acids thereof can be obtained by direct injection of the polypeptides into an animal or by administering the polypeptides to an animal, for example, a nonhuman. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al., Immunology Today 4:72, 1983) and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of The invention, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of The invention, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides (e.g., xylanases) and/or antibodies of the invention. The kits also can contain instructional material teaching the methodologies and industrial, research, medical, pharmaceutical, food and feed and food and feed supplement processing and other applications and processes of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified xylanase activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the xylanases of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., a xylanase message) or generating new (e.g., xylanase) transcripts in a cell. This increased or decreased expression can be traced by testing for the presence of a xylanase of the invention or by xylanase activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., a xylanase) or generating new polypeptides in a cell. This increased or decreased expression can be traced by determining the amount of xylanase present or by xylanase activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immunofluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial, Energy, Pharmaceutical, Medical, Food Processing and Other Applications Polypeptides of the invention can be used in any industrial, agricultural, food and feed and food and feed supplement processing, pharmaceutical, medical, research (laboratory) or other process. The invention provides industrial processes using enzymes of the invention, e.g., in the pharmaceutical or nutrient (diet) supplement industry, the energy industry (e.g., to make "clean" biofuels), in the food and feed industries, e.g., in methods for making food and feed products and food and feed additives. In one aspect, the invention provides processes using enzymes of the invention in the medical industry, e.g., to make pharmaceuticals or dietary aids or supplements, or food supplements and additives. In addition, the invention provides methods for using the enzymes of the invention in biofuel production, including, e.g., a bioalcohol such as bioethanol, biomethanol, biobutanol or biopropanol, thus comprising a "clean" fuel production.

The xylanase enzymes of the invention can be highly selective catalysts. They can catalyze reactions with exquisite stereo-, regio- and chemo-selectivities that are unparalleled in conventional synthetic chemistry. Moreover, enzymes are remarkably versatile. The xylanase enzymes of the invention can be tailored to function in organic solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

Wood, Paper and Pulp Treatments

The xylanases of the invention can be used in any wood, wood product, wood waste or by-product, paper, paper product, paper or wood pulp, Kraft pulp, or wood or paper recycling treatment or industrial process, e.g., any wood, wood pulp, paper waste, paper or pulp treatment or wood or paper deinking process. In one aspect, xylanases of the invention can be used to treat/pretreat paper pulp, or recycled paper or paper pulp, and the like. In one aspect, enzyme(s) of the invention are used to increase the "brightness" of the paper via their use in treating/pretreating paper pulp, or recycled paper or paper pulp, and the like. The higher the grade of paper, the greater the brightness; paper brightness can impact the scan capability of optical scanning equipment; thus, the enzymes and processes of the invention can be used to make high grade, "bright" paper for, e.g., use in optical scanning equipment, including inkjet, laser and photo printing quality paper.

For example, the enzymes of the invention can be used in any industrial process using xylanases known in the art, e.g., treating waste paper, as described in, e.g., U.S. Pat. No. 6,767,728 or 6,426,200; seasoning wood, e.g., for applications in the food industry, as described in, e.g., U.S. Pat. No. 6,623,953; for the production of xylose from a paper-grade hardwood pulp, as described in, e.g., U.S. Pat. No. 6,512,110; treating fibrous lignocellulosic raw material with a xylanase in an aqueous medium as described in, e.g., U.S. Pat. No. 6,287,708; dissolving pulp from cellulosic fiber, as described in, e.g., U.S. Pat. No. 6,254,722; deinking and decolorizing a printed paper or removing color from wood pulp, as described in, e.g., U.S. Pat. No. 6,241,849, 5,834,301 or 5,582,681; bleaching a chemical paper pulp or lignocellulose pulp using a xylanase, as described in, e.g., U.S. Pat. No. 5,645,686 or 5,618,386; for treating wood pulp that includes incompletely washed brownstock, as described in, e.g., U.S. Pat. No. 5,591,304; purifying and delignifying a waste lignocellulosic material, as described in, e.g., in U.S. Pat. No. 5,503,709; manufacturing paper or cardboard from recycled cellulose fibers, as described in, e.g., in U.S. Pat. No. 5,110,412; debarking of logs, as described in, e.g., in U.S. Pat. No. 5,103,883; producing fluff pulp with improved shredding properties, as described in, e.g., in U.S. Pat. No. 5,068,009, and the like. The xylanases of the invention can be used to process or treat any cellulosic material, e.g., fibers from wood, cotton, hemp, flax or linen.

In one aspect, the invention provides wood, wood pulp, paper, paper pulp, paper waste or wood or paper recycling treatment processes using a xylanase of the invention. In one aspect, the xylanase of the invention is applicable both in reduction of the need for a chemical bleaching agent, such as chlorine dioxide (see, e.g., Example 6, below), and in high alkaline and high temperature environments. Most lignin is solubilized in the cooking stage of pulping process. The residual lignin is removed from the pulp in the bleaching process. In one aspect, xylanase bleaching of pulp (e.g., using an enzyme of the invention) is based on the partial hydrolysis of xylan, which is the main component of the hemicellulose. The enzymatic action (e.g., of an enzyme of the invention) releases hemicellulose-bound lignin and increases the extractability of lignin from the pulp in the subsequent bleaching process, e.g. using chlorine and oxygen chemicals. In one aspect, xylanases of the invention can be used to increase the final brightness of the pulp at a fixed level of bleaching chemicals. In another aspect, xylanases of the invention can be used to decrease the kappa number of the pulp.

The invention provides wood, wood pulp, paper, paper pulp, paper waste or wood or paper recycling treatment processes (methods) using a xylanase of the invention where the treatment time (the amount of time the xylanase is in contact with the pulp, paper, wood, etc.) and/or retention time can be anywhere from between about 1 minute to 12 hours, or between about 5 minutes to 1 hour, or between about 15 to 30 minutes; or the treatment and/or retention time can be any time up to about 0.1, 0.25, 0.5, 0.75, 1, 1.5, 2, 3, 4, 5, 6, 7, 8, 9, 10, 11, 12 or more hours.

In one aspect, the xylanase of the invention is a thermostable alkaline endoxylanase which in one aspect can effect a greater than 25% reduction in the chlorine dioxide requirement of kraft pulp with a less than 0.5% pulp yield loss. In one aspect, boundary parameters are pH 10, 65-85° C. and treatment time of less than 60 minutes at an enzyme loading of less than 0.001 wt %; in alternative aspects the treatment and/or retention time is less than about 0.1, 0.25, 0.5, 0.75, 1, 1.5, 2, 3, 4, 5, 6, 7, 8, 9, 10, 11 or 12.

A pool of xylanases may be tested for the ability to hydrolyze dye-labeled xylan at, for example, pH 10 and 60° C. The enzymes that test positive under these conditions may then be evaluated at, for example pH 10 and 70° C. Alternatively, enzymes may be tested at pH 8 and pH 10 at 70° C. In discovery of xylanases desirable in the pulp and paper industry libraries from high temperature or highly alkaline environments were targeted. Specifically, these libraries were screened for enzymes functioning at alkaline pH and a temperature of approximately 45° C. In another aspect, the xylanases of the invention are useful in the pulp and paper industry in degradation of a lignin-hemicellulose linkage, in order to release the lignin.

Enzymes of the invention can be used for deinking printed wastepaper, such as newspaper, or for deinking noncontact-printed wastepaper, e.g., xerographic and laser-printed paper, and mixtures of contact and noncontact-printed wastepaper, as described in U.S. Pat. No. 6,767,728 or 6,426,200; Neo (1986) J. Wood Chem. Tech. 6(2):147. Enzymes of the invention can be used in processes for the production of xylose from a paper-grade hardwood pulp by extracting xylan contained in pulp into a liquid phase, subjecting the xylan contained in the obtained liquid phase to conditions sufficient to hydrolyze xylan to xylose, and recovering the xylose, where the extracting step includes at least one treatment of an aqueous suspension of pulp or an alkali-soluble material a xylanase enzyme, as described in, e.g., U.S. Pat. No. 6,512,110. Enzymes of the invention can be used in processes for dissolving pulp from cellulosic fibers such as recycled paper products made from hardwood fiber, a mixture of hardwood fiber and softwood fiber, waste paper, e.g., from unprinted envelopes, de-inked envelopes, unprinted ledger paper, de-inked ledger paper, and the like, as described in, e.g., U.S. Pat. No. 6,254,722.

In another aspect of the invention, the xylanases of the invention can also be used in any wood, wood product, paper, paper product, paper or wood pulp, Kraft pulp, or wood or paper recycling treatment or industrial process, e.g., any wood, wood pulp, paper waste, paper or pulp treatment or wood or paper deinking process as an antimicrobial or microbial repellent. Alternatively, the xylanases of the invention can be part of a wood, wood product, paper, paper product, paper or wood pulp, Kraft pulp, or recycled paper composition, and/or a composition comprising one or more wood, wood product, paper, paper product, paper or wood pulp, Kraft pulp, or recycled paper compositions, wherein the xylanases of the invention act as an antimicrobial or microbial repellent in the composition.

Treating Fibers and Textiles

The invention provides methods of treating fibers and fabrics using one or more xylanases of the invention. The xylanases can be used in any fiber- or fabric-treating method, which are well known in the art, see, e.g., U.S. Pat. Nos. 6,261,828; 6,077,316; 6,024,766; 6,021,536; 6,017,751; 5,980,581; US Patent Publication No. 20020142438 A1. For example, xylanases of the invention can be used in fiber and/or fabric desizing. In one aspect, the feel and appearance of a fabric is improved by a method comprising contacting the fabric with a xylanase of the invention in a solution. In one aspect, the fabric is treated with the solution under pressure. For example, xylanases of the invention can be used in the removal of stains.

The xylanases of the invention can be used to treat any cellulosic material, including fibers (e.g., fibers from cotton, hemp, flax or linen), sewn and unsewn fabrics, e.g., knits, wovens, denims, yarns, and toweling, made from cotton, cotton blends or natural or manmade cellulosics (e.g. originating from xylan-containing cellulose fibers such as from wood pulp) or blends thereof. Examples of blends are blends of cotton or rayon/viscose with one or more companion material such as wool, synthetic fibers (e.g. polyamide fibers, acrylic fibers, polyester fibers, polyvinyl alcohol fibers, polyvinyl chloride fibers, polyvinylidene chloride fibers, polyurethane fibers, polyurea fibers, aramid fibers), and cellulose-containing fibers (e.g. rayon/viscose, ramie, hemp, flax/linen, jute, cellulose acetate fibers, lyocell).

The textile treating processes of the invention (using xylanases of the invention) can be used in conjunction with other textile treatments, e.g., scouring and bleaching. Scouring is the removal of non-cellulosic material from the cotton fiber, e.g., the cuticle (mainly consisting of waxes) and primary cell wall (mainly consisting of pectin, protein and xyloglucan). A proper wax removal is necessary for obtaining a high wettability. This is needed for dyeing. Removal of the primary cell walls by the processes of the invention improves wax removal and ensures a more even dyeing. Treating textiles with the processes of the invention can improve whiteness in the bleaching process. The main chemical used in scouring is sodium, hydroxide in high concentrations and at high temperatures. Bleaching comprises oxidizing the textile. Bleaching typically involves use of hydrogen peroxide as the oxidizing agent in order to obtain either a fully bleached (white) fabric or to ensure a clean shade of the dye.

The invention also provides alkaline xylanases (xylanases active under alkaline conditions). These have wide-ranging applications in textile processing, degumming of plant fibers (e.g., plant bast fibers), treatment of pectic wastewaters, paper-making, and coffee and tea fermentations. See, e.g., Hoondal (2002) Applied Microbiology and Biotechnology 59:409-418.

In another aspect of the invention, the xylanases of the invention can also be used in any fiber- and/or fabric-treating process as an antimicrobial or microbial repellent. Alternatively, the xylanases of the invention can be part of a fiber- and/or fabric-composition, where the xylanases of the invention act as an antimicrobial or microbial repellent in the fiber and/or fabric.

Detergent, Disinfectant and Cleaning Compositions

The invention provides detergent, disinfectant or cleanser (cleaning or cleansing) compositions comprising one or more polypeptides (e.g., xylanases) of the invention, and methods of making and using these compositions. The invention incorporates all methods of making and using detergent, disinfectant or cleanser compositions, see, e.g., U.S. Pat. Nos. 6,413,928; 6,399,561; 6,365,561; 6,380,147. The detergent, disinfectant or cleanser compositions can be a one and two part aqueous composition, a non-aqueous liquid composition, a cast solid, a granular form, a particulate form, a compressed tablet, a gel and/or a paste and a slurry form. The xylanases of the invention can also be used as a detergent, disinfectant or cleanser additive product in a solid or a liquid form. Such additive products are intended to supplement or boost the performance of conventional detergent compositions and can be added at any stage of the cleaning process.

The actual active enzyme content depends upon the method of manufacture of a detergent, disinfectant or cleanser composition and is not critical, assuming the detergent solution has the desired enzymatic activity. In one aspect, the amount of xylanase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the xylanases of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Xylanases of the invention can be formulated into powdered and liquid detergents, disinfectants or cleansers having pH between 4.0 and 12.0 at levels of about 0.01 to about 5% (preferably 0.1% to 0.5%) by weight. These detergent, disinfectant or cleanser compositions can also include other enzymes such as xylanases, cellulases, lipases, esterases, proteases, or endoglycosidases, endo-beta.-1,4-glucanases, beta-glucanases, endo-beta-1,3(4)-glucanases, cutinases, peroxidases, catalases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases. These detergent, disinfectant or cleanser compositions can also include dyes, colorants, odorants, bleaches, buffers, builders, enzyme "enhancing agents" (see, e.g., U.S. Patent application no. 20030096394) and stabilizers.

The addition of xylanases of the invention to conventional cleaning compositions does not create any special use limitation. In other words, any temperature and pH suitable for the detergent is also suitable for the compositions of the invention as long as the enzyme is active at or tolerant of the pH and/or temperature of the intended use. In addition, the xylanases of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. A xylanase of the invention may be included as a detergent, disinfectant or cleanser additive. The detergent, disinfectant or cleanser composition of the invention may, for example, be formulated as a hand or machine laundry detergent, disinfectant or cleanser composition comprising a polypeptide of the invention. A laundry additive suitable for pre-treatment of stained fabrics can comprise a polypeptide of the invention. A fabric softener composition can comprise a xylanase of the invention. Alternatively, a xylanase of the invention can be formulated as a detergent, disinfectant or cleanser composition for use in general household hard surface cleaning operations. In alternative aspects, detergent, disinfectant or cleanser additives and detergent, disinfectant or cleanser compositions of the invention may comprise one or more other enzymes such as a xylanase, a lipase, a protease, a cutinase, an esterase, another xylanase, a carbohydrase, a cellulase, a pectinase, a mannanase, an arabinase, a galactanase, a xylanase, an oxidase, e.g., a lactase, and/or a peroxidase (see also, above). The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, xylanase enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

When formulated as compositions suitable for use in a laundry machine washing method, the xylanases of the invention can comprise both a surfactant and a builder compound. They can additionally comprise one or more detergent components, e.g., organic polymeric compounds, bleaching agents, additional enzymes, suds suppressors, dispersants, lime-soap dispersants, soil suspension and anti-redeposition agents and corrosion inhibitors. Laundry compositions of the invention can also contain softening agents, as additional detergent components. Such compositions containing carbohydrase can provide fabric cleaning, stain removal, whiteness maintenance, softening, color appearance, dye transfer inhibition and sanitization when formulated as laundry detergent compositions.

The density of the laundry detergent, disinfectant or cleanser compositions of the invention can range from about 200 to 1500 g/liter, or, about 400 to 1200 g/liter, or, about 500 to 950 g/liter, or, 600 to 800 g/liter, of composition; this can be measured at about 20° C.

In one aspect, the "compact" form of laundry detergent, disinfectant or cleanser compositions of the invention is best reflected by density and, in terms of composition, by the amount of inorganic filler salt. Inorganic filler salts are conventional ingredients of detergent compositions in powder form. In conventional detergent compositions, the filler salts are present in substantial amounts, typically 17% to 35% by weight of the total composition. In one aspect of the compact compositions, the filler salt is present in amounts not exceeding 15% of the total composition, or, not exceeding 10%, or, not exceeding 5% by weight of the composition. The inorganic filler salts can be selected from the alkali and alkaline-earth-metal salts of sulphates and chlorides, e.g., sodium sulphate.

Liquid detergent compositions of the invention can also be in a "concentrated form." In one aspect, the liquid detergent, disinfectant or cleanser compositions can contain a lower amount of water, compared to conventional liquid detergents, disinfectants or cleansers. In alternative aspects, the water content of the concentrated liquid detergent is less than 40%, or, less than 30%, or, less than 20% by weight of the detergent, disinfectant or cleanser composition. Detergent, disinfectant or cleanser compounds of the invention can comprise formulations as described in WO 97/01629.

Xylanases of the invention can be useful in formulating various detergent, cleaning, disinfectant or cleanser compositions. A number of known compounds are suitable surfactants including nonionic, anionic, cationic, or zwitterionic detergents, can be used, e.g., as disclosed in U.S. Pat. Nos. 4,404,128; 4,261,868; 5,204,015. In addition, xylanases can be used, for example, in bar or liquid soap applications, dish care formulations, contact lens cleaning solutions or products, peptide hydrolysis, waste treatment, textile applications, as fusion-cleavage enzymes in protein production, and the like. Xylanases may provide enhanced performance in a detergent composition as compared to another detergent xylanase, that is, the enzyme group may increase cleaning of certain enzyme sensitive stains such as grass or blood, as determined by usual evaluation after a standard wash cycle. Xylanases can be formulated into known powdered and liquid detergents having pH between 6.5 and 12.0 at levels of about 0.01 to about 5% (for example, about 0.1% to 0.5%) by weight. These detergent cleaning compositions can also include other enzymes such as known xylanases, xylanases, proteases, amylases, cellulases, mannanases, lipases or endoglycosidases, redox enzymes such as catalases and laccases, as well as builders, stabilizers, fragrances and pigments.

In one aspect, the invention provides detergent, disinfectant or cleanser compositions having xylanase activity (a xylanase of the invention) for use with fruit, vegetables and/or mud and clay compounds (see, for example, U.S. Pat. No. 5,786,316).

In another aspect of the invention, the xylanases of the invention can also be used in any detergent, disinfectant or cleanser (cleaning solution) manufacturing process, wherein the xylanase is used as an antimicrobial or microbial repellent. Alternatively, the xylanases of the invention can be used in any cleansing or washing process, wherein the xylanase is used as an antimicrobial or microbial repellent. In another aspect of the invention, the xylanase of the invention can be included in any detergent or cleanser composition, wherein the xylanases of the invention act as an antimicrobial or microbial repellent in the composition.

Treating Foods and Food Processing

The xylanases of the invention have numerous applications in food processing industry. For example, in one aspect, the xylanases of the invention are used to improve the extraction of oil from oil-rich plant material, e.g., oil-rich seeds, for example, soybean oil from soybeans, olive oil from olives, rapeseed oil from rapeseed and/or sunflower oil from sunflower seeds.

The xylanases of the invention can be used for separation of components of plant cell materials. For example, xylanases of the invention can be used in the separation of xylan-rich material (e.g., plant cells) into components. In one aspect, xylanases of the invention can be used to separate xylan-rich or oil-rich crops into valuable protein and oil and hull fractions. The separation process may be performed by use of methods known in the art.

The xylanases of the invention can be used in the preparation of fruit or vegetable juices, syrups, extracts and the like to increase yield. The xylanases of the invention can be used in the enzymatic treatment (e.g., hydrolysis of xylan-comprising plant materials) of various plant cell wall-derived materials or waste materials, e.g. from cereals, grains, wine or juice production, or agricultural residues such as vegetable hulls, bean hulls, sugar beet pulp, olive pulp, potato pulp, and the like. The xylanases of the invention can be used to modify the consistency and appearance of processed fruit or vegetables. The xylanases of the invention can be used to treat plant material to facilitate processing of plant material, including foods, facilitate purification or extraction of plant components. The xylanases of the invention can be used to improve feed value, decrease the water binding capacity, improve the degradability in waste water plants and/or improve the conversion of plant material to ensilage, and the like.

In one aspect, xylanases of the invention are used in baking applications, e.g., cookies and crackers, to hydrolyze xylans such as arabinoxylans. In one aspect, xylanases of the invention are used to create non-sticky doughs that are not difficult to machine and to reduce biscuit size. Xylanases of the invention can be used to hydrolyze arabinoxylans to prevent rapid rehydration of the baked product resulting in loss of crispiness and reduced shelf-life. In one aspect, xylanases of the invention are used as additives in dough processing. In one aspect, xylanases of the invention are used in dough conditioning, wherein in one aspect the xylanases possess high activity over a temperature range of about 25-35° C. and at near neutral pH (7.0-7.5). In one aspect, dough conditioning enzymes can be inactivated at the extreme temperatures of baking (>500° F.). The enzymes of the invention can be used in conjunction with any dough processing protocol, e.g., as in U.S. Patent App. No. 20050281916.

In one aspect, xylanases of the invention are used as additives in dough processing to perform optimally under dough pH and temperature conditions. In one aspect, an enzyme of the invention is used for dough conditioning. In one aspect, a xylanase of the invention possesses high activity over a temperature range of 25-35° C. and at near neutral pH (7.0-7.5). In one aspect, the enzyme is inactivated at the extreme temperatures of baking, for example, >500° F.

In another aspect of the invention, the xylanases of the invention can also be used in any food or beverage treatment or food or beverage processing process, wherein the xylanase is used as an antimicrobial or microbial repellent. In another aspect of the invention, the xylanase of the invention can be included in any food or bevereage composition, wherein the xylanases of the invention act as an antimicrobial or microbial repellent in the composition.

Animal Feeds and Food or Feed or Food Additives (Supplements)

The invention provides methods for treating animal feeds and foods and food or feed additives (supplements) using xylanases of the invention, animals including mammals (e.g., humans), birds, fish and the like. The invention provides animal feeds, foods, and additives (supplements) comprising xylanases of the invention. In one aspect, treating animal feeds, foods and additives using xylanases of the invention can help in the availability of nutrients, e.g., starch, protein, and the like, in the animal feed or additive (supplements). By breaking down difficult to digest proteins or indirectly or directly unmasking starch (or other nutrients), the xylanase makes nutrients more accessible to other endogenous or exogenous enzymes. The xylanase can also simply cause the release of readily digestible and easily absorbed nutrients and sugars.

When added to animal feed, xylanases of the invention improve the in vivo break-down of plant cell wall material partly due to a reduction of the intestinal viscosity (see, e.g., Bedford et al., Proceedings of the 1st Symposium on Enzymes in Animal Nutrition, 1993, pp. 73-77), whereby a better utilization of the plant nutrients by the animal is achieved. Thus, by using xylanases of the invention in feeds the growth rate and/or feed conversion ratio (i.e. the weight of ingested feed relative to weight gain) of the animal is improved.

The animal feed additive of the invention may be a granulated enzyme product which may readily be-mixed with feed components. Alternatively, feed additives of the invention can form a component of a pre-mix. The granulated enzyme product of the invention may be coated or uncoated. The particle size of the enzyme granulates can be compatible with that of feed and pre-mix components. This provides a safe and convenient mean of incorporating enzymes into feeds. Alternatively, the animal feed additive of the invention may be a stabilized liquid composition. This may be an aqueous or oil-based slurry. See, e.g., U.S. Pat. No. 6,245,546.

Xylanases of the present invention, in the modification of animal feed or a food, can process the food or feed either in vitro (by modifying components of the feed or food) or in vivo. Xylanases can be added to animal feed or food compositions containing high amounts of xylans, e.g. feed or food containing plant material from cereals, grains and the like. When added to the feed or food the xylanase significantly improves the in vivo break-down of xylan-containing material, e.g., plant cell walls, whereby a better utilization of the plant nutrients by the animal (e.g., human) is achieved. In one aspect, the growth rate and/or feed conversion ratio (i.e. weight of ingested feed relative to weight gain) of the animal is improved. For example a partially or indigestible xylan-comprising protein is fully or partially degraded by a xylanase of the invention, e.g. in combination with another enzyme, e.g., beta-galactosidase, to peptides and galactose and/or galactooligomers. These enzyme digestion products are more digestible by the animal. Thus, xylanases of the invention can contribute to the available energy of the feed or food. Also, by contributing to the degradation of xylan-comprising proteins, a xylanase of the invention can improve the digestibility and uptake of carbohydrate and non-carbohydrate feed or food constituents such as protein, fat and minerals.

In another aspect, xylanase of the invention can be supplied by expressing the enzymes directly in transgenic feed crops (as, e.g., transgenic plants, seeds and the like), such as grains, cereals, corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the xylanase of the invention is produced in recoverable quantities. The xylanase can be recovered from any plant or plant part. Alternatively, the plant or plant part containing the recombinant polypeptide can be used as such for improving the quality of a food or feed, e.g., improving nutritional value, palatability, and rheological properties, or to destroy an antinutritive factor.

In one aspect, the invention provides methods for removing oligosaccharides from feed prior to consumption by an animal subject using a xylanase of the invention. In this process a feed is formed having an increased metabolizable energy value. In addition to xylanases of the invention, galactosidases, cellulases and combinations thereof can be used.

In one aspect, the enzyme is added in an amount equal to between about 0.1% and 1% by weight of the feed material. In one aspect, the feed is a cereal, a wheat, a grain, a soybean (e.g., a ground soybean) material. See, e.g., U.S. Pat. No. 6,399,123.

In another aspect, the invention provides methods for utilizing xylanase as a nutritional supplement in the diets of animals by preparing a nutritional supplement containing a recombinant xylanase enzyme comprising at least thirty contiguous amino acids of a sequence of the invention, and administering the nutritional supplement to an animal to increase the utilization of xylan contained in food ingested by the animal.

In yet another aspect, the invention provides an edible pelletized enzyme delivery matrix and method of use for delivery of xylanase to an animal, for example as a nutritional supplement. The enzyme delivery matrix readily releases a xylanase enzyme, such as one having an amino acid sequence of the invention, or at least 30 contiguous amino acids thereof, in aqueous media, such as, for example, the digestive fluid of an animal. The invention enzyme delivery matrix is prepared from a granulate edible carrier selected from such components as grain germ that is spent of oil, hay, alfalfa, timothy, soy hull, sunflower seed meal, wheat midd, and the like, that readily disperse the recombinant enzyme contained therein into aqueous media. In use, the edible pelletized enzyme delivery matrix is administered to an animal to delivery of xylanase to the animal. Suitable grain-based substrates may comprise or be derived from any suitable edible grain, such as wheat, corn, soy, sorghum, alfalfa, barley, and the like. An exemplary grain-based substrate is a corn-based substrate. The substrate may be derived from any suitable part of the grain, but is preferably a grain germ approved for animal feed use, such as corn germ that is obtained in a wet or dry milling process. The grain germ preferably comprises spent germ, which is grain germ from which oil has been expelled, such as by pressing or hexane or other solvent extraction. Alternatively, the grain germ is expeller extracted, that is, the oil has been removed by pressing.

The enzyme delivery matrix of the invention is in the form of discrete plural particles, pellets or granules. By "granules" is meant particles that are compressed or compacted, such as by a pelletizing, extrusion, or similar compacting to remove water from the matrix. Such compression or compacting of the particles also promotes intraparticle cohesion of the particles. For example, the granules can be prepared by pelletizing the grain-based substrate in a pellet mill. The pellets prepared thereby are ground or crumbled to a granule size suitable for use as an adjuvant in animal feed. Since the matrix is itself approved for use in animal feed, it can be used as a diluent for delivery of enzymes in animal feed.

The enzyme delivery matrix can be in the form of granules having a granule size ranging from about 4 to about 400 mesh (USS); more preferably, about 8 to about 80 mesh; and most preferably about 14 to about 20 mesh. If the grain germ is spent via solvent extraction, use of a lubricity agent such as corn oil may be necessary in the pelletizer, but such a lubricity agent ordinarily is not necessary if the germ is expeller extracted. In other aspects of the invention, the matrix is prepared by other compacting or compressing processes such as, for example, by extrusion of the grain-based substrate through a die and grinding of the extrudate to a suitable granule size.

The enzyme delivery matrix may further include a polysaccharide component as a cohesiveness agent to enhance the cohesiveness of the matrix granules. The cohesiveness agent is believed to provide additional hydroxyl groups, which enhance the bonding between grain proteins within the matrix granule. It is further believed that the additional hydroxyl groups so function by enhancing the hydrogen bonding of proteins to starch and to other proteins. The cohesiveness agent may be present in any amount suitable to enhance the cohesiveness of the granules of the enzyme delivery matrix. Suitable cohesiveness agents include one or more of dextrins, maltodextrins, starches, such as corn starch, flours, cellulosics, hemicellulosics, and the like. For example, the percentage of grain germ and cohesiveness agent in the matrix (not including the enzyme) is 78% corn germ meal and 20% by weight of corn starch.

Because the enzyme-releasing matrix of the invention is made from biodegradable materials and contains moisture, the matrix may be subject to spoilage, such as by molding. To prevent or inhibit such molding, the matrix may include a mold inhibitor, such as a propionate salt, which may be present in any amount sufficient to inhibit the molding of the enzyme-releasing matrix, thus providing a delivery matrix in a stable formulation that does not require refrigeration.

The xylanase enzyme contained in the invention enzyme delivery matrix and methods is preferably a thermostable xylanase, as described herein, so as to resist inactivation of the xylanase during manufacture where elevated temperatures and/or steam may be employed to prepare the pelletized enzyme delivery matrix. During digestion of feed containing the invention enzyme delivery matrix, aqueous digestive fluids will cause release of the active enzyme. Other types of thermostable enzymes and nutritional supplements that are thermostable can also be incorporated in the delivery matrix for release under any type of aqueous conditions.

A coating can be applied to the invention enzyme matrix particles for many different purposes, such as to add a flavor or nutrition supplement to animal feed, to delay release of animal feed supplements and enzymes in gastric conditions, and the like. Or, the coating may be applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise a xylanase enzyme encoded by an amino acid sequence of the invention or at least 30 consecutive amino acids thereof. Preferably, the process includes compacting or compressing the particles of enzyme-releasing matrix into granules, which can be accomplished by pelletizing. The mold inhibitor and cohesiveness agent, when used, can be added at any suitable time, and can be mixed with the grain-based substrate in the desired proportions prior to pelletizing of the grain-based substrate. Moisture content in the pellet mill feed can be in the ranges set forth above with respect to the moisture content in the finished product, and can be about 14-15%. In one aspect, moisture is added to the feedstock in the form of an aqueous preparation of the enzyme to bring the feedstock to this moisture content. The temperature in the pellet mill can be brought to about 82° C. with steam. The pellet mill may be operated under any conditions that impart sufficient work to the feedstock to provide pellets. The pelleting process itself is a cost-effective process for removing water from the enzyme-containing composition.

In one aspect, the pellet mill is operated with a ⅛ in. by 2 inch die at 100 lb./min. pressure at 82° C. to provide pellets, which then are crumbled in a pellet mill crumbler to provide discrete plural particles having a particle size capable of passing through an 8 mesh screen but being retained on a 20 mesh screen.

The thermostable xylanases of the invention can be used in the pellets of the invention. They can have high optimum temperatures and high heat resistance such that an enzyme reaction at a temperature not hitherto carried out can be achieved. The gene encoding the xylanase according to the present invention (e.g. as set forth in any of the sequences in the invention) can be used in preparation of xylanases (e.g. using GSSM as described herein) having characteristics different from those of the xylanases of the invention (in terms of optimum pH, optimum temperature, heat resistance, stability to solvents, specific activity, affinity to substrate, secretion ability, translation rate, transcription control and the like). Furthermore, a polynucleotide of the invention may be employed for screening of variant xylanases prepared by the methods described herein to determine those having a desired activity, such as improved or modified thermostability or thermotolerance. For example, U.S. Pat. No. 5,830,732, describes a screening assay for determining thermotolerance of a xylanase.

In another aspect of the invention, the xylanases of the invention can also be used in any animal feed, animal food or feed additive production process, wherein the xylanase is used as an antimicrobial or microbial repellent. In another aspect of the invention, the xylanase of the invention can be included in any animal feed, animal food or feed additive composition, wherein the xylanases of the invention act as an antimicrobial or microbial repellent in the composition.

Waste Treatment

The xylanases of the invention can be used in a variety of other industrial applications, e.g., in waste treatment. For example, in one aspect, the invention provides a solid waste digestion process using xylanases of the invention. The methods can comprise reducing the mass and volume of substantially untreated solid waste. Solid waste can be treated with an enzymatic digestive process in the presence of an enzymatic solution (including xylanases of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In another aspect of the invention, the xylanases of the invention can also be used in any waste treatment process, wherein the xylanase is used as an antimicrobial or microbial repellent. In another aspect of the invention, the xylanase of the invention can be included in any waste treatment composition, wherein the xylanases of the invention act as an antimicrobial or microbial repellent in the composition.

Oral Care Products

The invention provides oral care product comprising xylanases of the invention, including the enzyme mixtures or "cocktails" of the invention. Exemplary oral care products include toothpastes, dental creams, gels or tooth powders, odontics, mouth washes, pre- or post brushing rinse formulations, chewing gums, lozenges, or candy. See, e.g., U.S. Pat. No. 6,264,925.

In another aspect of the invention, the xylanases of the invention, including the enzyme mixtures or "cocktails" of the invention, can also be used in any oral care manufacturing process, wherein the xylanase is used as an antimicrobial or microbial repellent. In another aspect of the invention, the xylanase of the invention, including the enzyme mixtures or "cocktails" of the invention, can be included in any oral care composition, wherein the xylanases of the invention act as an antimicrobial or microbial repellent in the composition.

Brewing and Fermenting

The invention provides methods of brewing (e.g., fermenting) beer comprising xylanases of the invention, including the enzyme mixtures or "cocktails" of the invention. In one exemplary process, starch-containing raw materials are disintegrated and processed to form a malt. A xylanase of the invention is used at any point in the fermentation process. For example, xylanases of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15 to 25° C. for 3 to 6 days when enzyme synthesis is stimulated under the control of gibberellins. In one aspect, xylanases of the invention are added at this (or any other) stage of the process. Xylanases of the invention can be used in any beer or alcoholic beverage producing process, as described, e.g., in U.S. Pat. Nos. 5,762,991; 5,536,650; 5,405,624; 5,021,246; 4,788,066.

In one aspect, an enzyme of the invention is used to improve filterability and wort viscosity and to obtain a more complete hydrolysis of endosperm components. Use of an enzyme of the invention would also increase extract yield. The process of brewing involves germination of the barley grain (malting) followed by the extraction and the breakdown of the stored carbohydrates to yield simple sugars that are used by yeast for alcoholic fermentation. Efficient breakdown of the carbohydrate reserves present in the barley endosperm and brewing adjuncts requires the activity of several different enzymes.

In one aspect, an enzyme of the invention has activity in slightly acidic pH (e.g., 5.5-6.0) in, e.g., the 40° C. to 70° C. temperature range; and, in one aspect, with inactivation at 95° C. Activity under such conditions would be optimal, but are not an essential requirement for efficacy. In one aspect, an enzyme of the invention has activity between 40-75° C., and pH 5.5-6.0; stable at 70° for at least 50 minutes, and, in one aspect, is inactivated at 96-100° C. Enzymes of the invention can be used with other enzymes, e.g., beta-1,4-endoglucanases and amylases.

In another aspect of the invention, the xylanases of the invention, including the enzyme mixtures or "cocktails" of the invention, can also be used in any brewing or fermentation process, wherein the xylanase is used as an antimicrobial or microbial repellent. In another aspect of the invention, the xylanase of the invention can be included in any brewed or fermented composition, wherein the xylanases of the invention act as an antimicrobial or microbial repellent in the composition.

Biomass conversion and Biofuel Production

The invention provides methods and processes for biomass conversion, e.g., to a biofuel, such as bioethanol, biomethanol, biopropanol and/or biobutanol and the like, using enzymes of the invention, including the enzyme mixtures or "cocktails" of the invention. Thus, the invention provides fuels, e.g., biofuels, such as bioethanols, comprising a polypeptide of the invention, including the enzyme mixtures or "cocktails" of the invention, or a polypeptide encoded by a nucleic acid of the invention. In alternative aspects, the fuel is derived from a plant material, which optionally comprises potatoes, soybean (rapeseed), barley, rye, corn, oats, wheat, beets or sugar cane, and optionally the fuel comprises a bioethanol or a gasoline-ethanol mix.

The invention provides methods for making a fuel comprising contacting a composition comprising a xylan, hemicellulose, cellulose or a fermentable sugar with a polypeptide of the invention, or a polypeptide encoded by a nucleic acid of the invention, or any one of the mixtures or "cocktails" or products of manufacture of the invention. In alternative embodiments, the composition comprising a xylan, hemicellulose, a cellulose or a fermentable sugar comprises a plant, plant product or plant derivative, and the plant or plant product can comprise cane sugar plants or plant products, beets or sugarbeets, wheat, corn, soybeans, potato, rice or barley. In alternative embodiments, the polypeptide has activity comprising catalyzing hydrolysis of internal β-1,4-xylosidic linkages or endo-β-1,4-glucanase linkages; and/or degrading a linear polysaccharide beta-1,4-xylan into xylose. In one aspect, the fuel comprises a bioethanol or a gasoline-ethanol mix, or a biopropanol or a gasoline-propanol mix, or a biobutanol or a gasoline-butanol mix, or a biomethanol or a gasoline-methanol mix, or any combination thereof.

The invention provides methods for making bioethanol, biobutanol, biomethanol and/or a biopropanol comprising contacting a composition comprising a xylan, hemi-cellulose, cellulose or a fermentable sugar with a polypeptide of the invention, or a polypeptide encoded by a nucleic acid of the invention, or any one of the mixtures or "cocktails" or products of manufacture of the invention. In alternative embodiments, the composition comprising a cellulose or a fermentable sugar comprises a plant, plant product or plant derivative, and the plant or plant product can comprise cane sugar plants or plant products, beets or sugarbeets, wheat, corn, soybeans, potato, rice or barley, and the polypeptide can have activity comprising cellulase, glucanase, cellobiohydrolase, beta-glucosidase, xylanase, mannanse, β-xylosidase, and/or arabinofuranosidase activity.

The invention provides enzyme ensembles, or "cocktail", for depolymerization of cellulosic and hemicellulosic polymers to metabolizeable carbon moieties comprising a polypeptide of the invention, or a polypeptide encoded by a nucleic acid of the invention. In alternative embodiments, the polypeptide has activity comprising catalyzing hydrolysis of internal β-1,4-xylosidic linkages or endo-β-1,4-glucanase linkages; and/or degrading a linear polysaccharide beta-1,4-xylan into xylose. The enzyme ensembles, or "cocktails", of the invention can be in the form of a composition (e.g., a formulation, liquid or solid), e.g., as a product of manufacture.

The invention provides compositions (including products of manufacture, enzyme ensembles, or "cocktails") comprising a mixture (or "cocktail") of hemicellulose- and cellulose-hydrolyzing enzymes, wherein the xylan-hydrolyzing enzymes comprise at least one of each of a xylanase of the invention and at least one, several or all of a cellulase, glucanase, a cellobiohydrolase and/or a β-glucosidase. In alternative embodiments, the xylan-hydrolyzing and/or hemicellulose-hydrolyzing mixtures of the invention comprise at least one of each of a xylanase of the invention and at least one or both of a β-xylosidase and/or an arabinofuranosidase.

The invention provides compositions (including products of manufacture, enzyme ensembles, or "cocktails") comprising a mixture (or "cocktail") of xylan-hydrolyzing, hemicellulose- and/or cellulose-hydrolyzing enzymes comprising at least one, several or all of a cellulase, a glucanase, a cellobiohydrolase and/or an arabinofuranosidase, and a xylanase of this invention.

The invention provides compositions (including products of manufacture, enzyme ensembles, or "cocktails") comprising mixture (or "cocktail") of xylan-hydrolyzing, hemicellulose- and/or cellulose-hydrolyzing enzymes comprising at least one, several or all of a cellulase, a glucanase, a cellobiohydrolase; an arabinofuranosidase; a xylanase; a β-glucosidase; a β-xylosidase; and at least one enzyme of the invention.

The invention provides compositions (including products of manufacture, enzyme ensembles, or "cocktails") comprising mixture (or "cocktail") of enzymes comprising, in addition to at least one enzyme of the invention: (1) a glucanase which cleaves internal β-1,4 linkages resulting in shorter glucooligosaccharides, (2) a cellobiohydrolase which acts in an "exo" manner processively releasing cellobiose units (β-1,4 glucose-glucose disaccharide), and/or (3) a β-glucosidase for releasing glucose monomer from short cellooligosaccharides (e.g. cellobiose).

Biomass Conversion and Production of Clean Bio Fuels

The invention provides compositions and processes using enzymes of this invention, including mixtures, or "cocktails" of enzymes of the invention, for the conversion of a biomass, or any organic material, e.g., any xylan-comprising or lignocellulosic material (e.g., any composition comprising a xylan, cellulose, hemicellulose and/or lignin), to a fuel, such as a biofuel (e.g., bioethanol, biobutanol, biomethanol and/or a biopropanol), including biodiesels, in addition to feeds, foods, food or feed supplements (additives), pharmaceuticals and chemicals. Thus, the compositions and methods of the invention provide effective and sustainable alternatives or adjuncts to use of petroleum-based products, e.g., as a mixture of a biofuel (e.g., bioethanol, biobutanol, biomethanol and/or a biopropanol) and gasoline and/or diesel fuel.

The invention provides cells and/or organisms expressing enzymes of the invention (e.g., wherein the cells or organisms comprise as heterologous nucleic acids a sequence of this invention) for participation in chemical cycles involving natural biomass (e.g., plant) conversion. In one aspect, enzymes and methods for the conversion are used in enzyme ensembles (or "cocktails") for the efficient depolymerization of xylan-comprising compositions, or xylan, cellulosic and hemicellulosic polymers, to metabolizeable carbon moieties. The invention provides methods for discovering and implementing the most effective of enzymes to enable these important new "biomass conversion" and alternative energy industrial processes.

The methods of the invention also include taking the converted biomass (e.g., lignocellulosic) material (processed by enzymes of the invention) and making it into a fuel (e.g. a biofuel such as a bioethanol, biobutanol, biomethanol, a biopropanol, or a biodiesel) by fermentation and/or by chemical synthesis. In one aspect, the produced sugars are fermented and/or the non-fermentable products are gasified.

The enzymes of the invention (including, for example, organisms, such as microorganisms, e.g., fungi, yeast or bacteria, and plants and plant cells and plant parts, e.g., seeds, making and in some aspects secreting recombinant enzymes of the invention) can be used in or included/integrated at any stage of any organic matter/biomass conversion process, e.g., at any one step, several steps, or included in all of the steps, or all of the following methods of biomass conversion processes, or all of these biofuel alternatives:

Direct combustion: the burning of material by direct heat and is the simplest biomass technology; can be very economical if a biomass source is nearby.

Prolysis: is the thermal degradation of biomass by heat in the absence of oxygen. In one aspect, biomass is heated to a temperature between about 800 and 1400 degrees Fahrenheit, but no oxygen is introduced to support combustion resulting in the creation of gas, fuel oil and charcoal.

2 Gasification: biomass can be used to produce methane through heating or anaerobic digestion. Syngas, a mixture of carbon monoxide and hydrogen, can be derived from biomass.

Landfill Gas: is generated by the decay (anaerobic digestion) of buried garbage in landfills. When the organic waste decomposes, it generates gas consisting of approximately 50% methane, the major component of natural gas.

Anaerobic digestion: converts organic matter to a mixture of methane, the major component of natural gas, and carbon dioxide. In one aspect, biomass such as waterwaste (sewage), manure, or food processing waste, is mixed with water and fed into a digester tank without air.

Fermentation

Alcohol Fermentation: fuel alcohol is produced by converting starch to sugar, fermenting the sugar to alcohol, then separating the alcohol water mixture by distillation. Feedstocks such as wheat, barley, potatoes, and waste paper, sawdust, and straw containing sugar, starch, or cellulose can be converted to alcohol by fermentation with yeast.

Transesterification: An exemplary reaction for converting oil to biodiesel is called transesterification. The transesterification process reacts an alcohol (like methanol) with the triglyceride oils contained in vegetable oils, animal fats, or recycled greases, forming fatty acid alkyl esters (biodiesel) and glycerin. The reaction requires heat and a strong base catalyst, such as sodium hydroxide or potassium hydroxide.

Biodiesel: Biodiesel is a mixture of fatty acid alkyl esters made from vegetable oils, animal fats or recycled greases. Biodiesel can be used as a fuel for vehicles in its pure form, but it is usually used as a petroleum diesel additive to reduce levels of particulates, carbon monoxide, hydrocarbons and air toxics from diesel-powered vehicles.

Hydrolysis: includes hydrolysis of a compound, e.g., a biomass, such as a lignocellulosic material, catalyzed using an enzyme of the instant invention.

Congeneration: is the simultaneous production of more than one form of energy using a single fuel and facility. In one aspect, biomass cogeneration has more potential growth than biomass generation alone because cogeneration produces both heat and electricity.

In one aspect, the polypeptides of the invention have sufficient enzymatic activity for, or can be used with other enzymes in a process for, generating a biodiesel or a fuel, e.g. a biofuel, such as a bioethanol, biobutanol, biomethanol, a biopropanol, from an organic material, e.g., a biomass, such as compositions derived from plants and animals, including any agricultural crop or other renewable feedstock, an agricultural residue or an animal waste, or the organic components of municipal and industrial wastes, or microorganisms such as algae or yeast.

In one aspect, polypeptides of the invention are used in processes for converting an organic material, e.g., a biomass, such as a lignocellulosic biomass, to a biofuel, such as a bioethanol, biobutanol, biomethanol, a biopropanol, or otherwise are used in processes for hydrolyzing or digesting biomaterials such that they can be used as a biofuel (including biodiesel or bioethanol, biobutanol, biomethanol or biopropanol), or for making it easier for the biomass to be processed into a fuel. In an alternative aspect, polypeptides of the invention are used in processes for a transesterification process reacting an alcohol (like methanol, butanol, propanol, ethanol) with a triglyceride oil contained in a vegetable oil, animal fat or recycled greases, forming fatty acid alkyl esters (biodiesel) and glycerin. In one aspect, biodiesel is made from soybean oil or recycled cooking oils. Animal's fats, other vegetable oils, and other recycled oils can also be used to produce biodiesel, depending on their costs and availability. In another aspect, blends of all kinds of fats and oils are used to produce a biodiesel fuel of the invention.

Enzymes of the invention can also be used in glycerin refining. The glycerin by-product contains unreacted catalyst and soaps that are neutralized with an acid. Water and alcohol are removed to produce 50% to 80% crude glycerin. The remaining contaminants include unreacted fats and oils, which can be processes using the polypeptides of the invention. In a large biodiesel plants of the invention, the glycerin can be further purified, e.g., to 99% or higher purity, for the pharmaceutical and cosmetic industries.

Both bioethanol and biodiesel made using the polypeptides of the invention can be used with fuel oxygenates to improve combustion characteristics. Adding oxygen results in more complete combustion, which reduces carbon monoxide emissions. This is another environmental benefit of replacing petroleum fuels with biofuels (e.g., a fuel of the invention). A bioethanol made using the compositions and/or methods of this invention can be blended with gasoline to form an E10 blend (about 5% to 10% ethanol and about 90% to 95% gasoline), but it can be used in higher concentrations such as E85 or in its pure form. A bioethanol made using the compositions and/or methods of this invention can be blended with petroleum diesel to form a B20 blend (20% biodiesel and 80% petroleum diesel), although other blend levels can be used up to B 100 (pure biodiesel).

In one aspect, the polypeptides of this invention are used in processes for converting organic material, e.g., a biomass, such as a lignocellulosic biomass, to methanol, butanol, propanol and/or ethanol. The invention also provides processes for making ethanol ("bioethanol") methanol, butanol and/or propanol from compositions comprising organic material, e.g., a biomass, such as a lignocellulosic biomass. The organic material, e.g., a biomass, such as a lignocellulose biomass material, can be obtained from agricultural crops, as a byproduct of food or feed production, or as biomass waste products, such as plant residues and waste paper. Examples of suitable plant residues for treatment with polypeptides of the invention include grains, seeds, stems, leaves, hulls, husks, corn cobs, corn stover, straw, grasses (e.g., Indian grass, such as *Sorghastrum nutans*; or, switch grass, e.g., *Panicum* species, such as *Panicum virgatum*), and the like, as well as wood, wood chips, wood pulp, and sawdust. Examples of paper waste suitable for treatment with polypeptides of the invention include discard photocopy paper, computer printer paper, notebook paper, notepad paper, typewriter paper, and the like, as well as newspapers, magazines, cardboard, and paper-based packaging materials.

In one aspect, the enzymes and methods of the invention can be used in conjunction with more "traditional" means of making methanol, butanol, propanol and/or ethanol from biomass, e.g., as methods comprising hydrolyzing biomass (e.g., lignocellulosic materials) by subjecting dried biomass material in a reactor to a catalyst comprised of a dilute solution of a strong acid and a metal salt; this can lower the activation energy, or the temperature, of cellulose hydrolysis to obtain higher sugar yields; see, e.g., U.S. Pat. Nos. 6,660,506; 6,423,145.

Another exemplary method that incorporated use of enzymes of the invention comprises hydrolyzing biomass (e.g., lignocellulosic materials) containing xylan, hemicellulose, cellulose and/or lignin by subjecting the material to a first stage hydrolysis step in an aqueous medium at a temperature and a pressure chosen to effect primarily depolymerization of hemicellulose without major depolymerization of cellulose to glucose. This step results in a slurry in which the liquid aqueous phase contains dissolved monosaccharides resulting from depolymerization of hemicellulose and a solid phase containing cellulose and lignin. A second stage hydrolysis step can comprise conditions such that at least a major portion of the cellulose is depolymerized, such step resulting in a liquid aqueous phase containing dissolved/soluble depolymerization products of cellulose. See, e.g., U.S. Pat. No. 5,536,325. Enzymes of the invention can be added at any stage of this exemplary process.

Another exemplary method that incorporated use of enzymes of the invention comprises processing a biomass material by one or more stages of dilute acid hydrolysis with about 0.4% to 2% strong acid; and treating an unreacted solid lignocellulosic component of the acid hydrolyzed biomass material by alkaline delignification to produce precursors for biodegradable thermoplastics and derivatives. See, e.g., U.S. Pat. No. 6,409,841. Enzymes of the invention can be added at any stage of this exemplary process.

Another exemplary method that incorporated use of enzymes of the invention comprises prehydrolyzing biomass (e.g., lignocellulosic materials) in a prehydrolysis reactor; adding an acidic liquid to the solid lignocellulosic material to make a mixture; heating the mixture to reaction temperature; maintaining reaction temperature for time sufficient to fractionate the lignocellulosic material into a solubilized portion containing at least about 20% of the lignin from the lignocellulosic material and a solid fraction containing cellulose; removing a solubilized portion from the solid fraction while at or near reaction temperature wherein the cellulose in the solid fraction is rendered more amenable to enzymatic digestion; and recovering a solubilized portion. See, e.g., U.S. Pat. No. 5,705,369. Enzymes of the invention can be added at any stage of this exemplary process.

The invention provides methods for making motor fuel compositions (e.g., for spark ignition motors) based on liquid hydrocarbons blended with a fuel grade alcohol made by using an enzyme or a method of the invention. In one aspect, the fuels made by use of an enzyme of the invention comprise, e.g., coal gas liquid- or natural gas liquid-ethanol blends. In one aspect, a co-solvent is biomass-derived 2-methyltetrahydrofuran (MTHF). See, e.g., U.S. Pat. No. 6,712,866.

In one aspect, methods of the invention for the enzymatic degradation of biomass (e.g., lignocellulosic materials), e.g., for production of a biofuel, e.g., an ethanol, from a biomass or any organic material, can also comprise use of ultrasonic treatment of a biomass material; see, e.g., U.S. Pat. No. 6,333,181.

In another aspect, methods of the invention for producing a biofuel, e.g., an ethanol (a bioethanol) from a biomass (e.g., a cellulosic) substrate comprise providing a reaction mixture in the form of a slurry comprising biomass (e.g., a cellulosic) substrate, an enzyme of this invention and a fermentation agent (e.g., within a reaction vessel, such as a semi-continuously solids-fed bioreactor), and the reaction mixture is reacted under conditions sufficient to initiate and maintain a fermentation reaction (as described, e.g., in U.S. Pat. App. No. 20060014260). In one aspect, experiment or theoretical calculations can determine an optimum feeding frequency. In one aspect, additional quantities of the biomass (e.g., a cellulosic) substrate and the enzyme are provided into the reaction vessel at an interval(s) according to the optimized feeding frequency.

One exemplary process for making a biofuels and biodiesels of the invention is described in U.S. Pat. App. Pub. Nos. 20050069998; 20020164730; and in one aspect comprises stages of grinding the biomass (e.g., lignocellulosic material) (e.g., to a size of 15-30 mm), subjecting the product obtained to steam explosion pre-treatment (e.g., at a temperature of 190-230° C.) for between 1 and 10 minutes in a reactor; collecting the pre-treated material in a cyclone or related product of manufacture; and separating the liquid and solid fractions by filtration in a filter press, introducing the solid fraction in a fermentation deposit and adding one or more enzymes of the invention, and in one aspect, another enzyme is also added, e.g., a cellulase and/or beta-glucosidase enzyme (e.g., dissolved in citrate buffer pH 4.8).

Another exemplary process for making a biofuels and biodiesels of the invention comprising methanol, butanol, propanol and/or ethanol using enzymes of the invention comprises pretreating a starting material comprising a biomass (e.g., a lignocellulosic) feedstock comprising at least a xylan, a hemicellulose and/or a cellulose. In one aspect, the starting material comprises potatoes, soybean (rapeseed), barley, rye, corn, oats, wheat, beets or sugar cane or a component or waste or food or feed production byproduct. The starting material ("feedstock") is reacted at conditions which disrupt the plant's fiber structure to effect at least a partial hydrolysis of the biomass (e.g., hemicellulose and/or cellulose). Disruptive conditions can comprise, e.g., subjecting the starting material to an average temperature of 180° C. to 270° C. at pH 0.5 to 2.5 for a period of about 5 seconds to 60 minutes; or, temperature of 220° C. to 270° C., at pH 0.5 to 2.5 for a period of 5 seconds to 120 seconds, or equivalent. This generates a feedstock with increased accessibility to being digested by an enzyme, e.g., a cellulase enzyme of the invention. U.S. Pat. No. 6,090,595. Exemplary conditions for hydrolysis of biomass (e.g., a lignocellulosic material) by an enzyme of this invention include reactions at temperatures between about 30° C. and 48° C., and/or a pH between about 4.0 and 6.0. Other exemplary conditions include a temperature between about 30° C. and 60° C. and a pH between about 4.0 and 8.0.

Biofuels and Biologically Produced Alcohols

The invention provides biofuels and synthetic fuels, including liquids and gases (e.g., syngas) and biologically produced alcohols, and methods for making them, using the compositions (e.g., enzyme and nucleic acids, and transgenic plants, animal, seeds and microorganisms) and methods of the invention. The invention provides biofuels and biologically produced alcohols comprising enzymes, nucleic acids, transgenic plants, animals (e.g., microorganisms, such as bacteria or yeast) and/or seeds of the invention. In one aspect, these biofuels and biologically produced alcohols are produced from a biomass.

The invention provides biologically produced alcohols, such as ethanol, methanol, propanol and butanol produced by methods of the invention, which include the action of microbes and enzymes of the invention through fermentation (hydrolysis) to result in an alcohol fuel.

Biofuels as a Liquid or a Gas Gasoline

The invention provides biofuels and synthetic fuels in the form of a gas, or gasoline, e.g., a syngas. In one aspect, methods of the invention comprising use of enzymes of the invention for chemical cycles for natural biomass conversion, e.g., for the hydrolysis of a biomass to make a biofuel, e.g., a bioethanol, biopropanol, bio-butanol or a biomethanol, or a synthetic fuel, in the form of a liquid or as a gas, such as a "syngas".

For example, invention provides methods for making biofuel gases and synthetic gas fuels ("syngas") comprising a bioethanol, biopropanol, bio-butanol and/or a biomethanol made using a polypeptide of the invention, or made using a method of the invention; and in one aspect this biofuel gas of the invention is mixed with a natural gas (can also be produced from biomass), e.g., a hydrogen or a hydrocarbon-based gas fuel.

In one aspect, the invention provides methods for processing biomass to a synthetic fuel, e.g., a syngas, such as a syngas produced from a biomass by gasification. In one aspect, the invention provides methods for making an ethanol, propanol, butanol and/or methanol gas from a sugar cane, e.g., a bagasse. In one aspect, this fuel, or gas, is used as motor fuel, e.g., an automotive, truck, airplane, boat, small engine, etc. fuel. In one aspect, the invention provides methods for making an ethanol, propanol, butanol and/or methanol from a plant, e.g., corn, or a plant product, e.g., hay or straw (e.g., a rice straw or a wheat straw, or any the dry stalk of any cereal plant), or an agricultural waste product. Cellulosic ethanol, propanol, butanol and/or methanol can be manufactured from a plant, e.g., corn, or plant product, e.g., hay or straw, or an agricultural waste product (e.g., as processed by Iogen Corporation of Ontario, Canada).

In one aspect, the ethanol, propanol, butanol and/or methanol made using a method of composition of the invention can be used as a fuel (e.g., a gasoline) additive (e.g., an oxygenator) or in a direct use as a fuel. For example, a ethanol, propanol, butanol and/or methanol, including a fuel, made by a method of the invention can be mixed with ethyl tertiary butyl ether (ETBE), or an ETBE mixture such as ETBE containing 47% ethanol as a biofuel, or with MTBE (methyl tertiary-butyl ether). In another aspect, a ethanol, propanol, butanol and/or methanol, including a fuel, made by a method of the invention can be mixed with:

| IUPAC name | Common name |
|---|---|
| but-1-ene | α-butylene |
| cis-but-2-ene | cis-β-butylene |
| trans-but-2-ene | trans-β-butylene |
| 2-methylpropene | isobutylene |

A butanol and/or ethanol made by a method of the invention (e.g., using an enzyme of the invention) can be further processed using "A.B.E." (Acetone, Butanol, Ethanol) fermentation; in one aspect, butanol being the only liquid product. In one aspect, this butanol and/or ethanol is burned "straight" in existing gasoline engines (without modification to the engine or car), produces more energy and is less corrosive and less water soluble than ethanol, and can be distributed via existing infrastructures.

The invention also provides mixed alcohols wherein one, several or all of the alcohols are made by processes comprising at least one method of the invention (e.g., using an enzyme of the invention), e.g., comprising a mixture of ethanol, propanol, butanol, pentanol, hexanol, and heptanol, such as ECALENE™ (Power Energy Fuels, Inc., Lakewood, Colo.), e.g.:

| Exemplary Fuel of the Invention | |
|---|---|
| Component | Weight % |
| Methanol | 0% |
| Ethanol | 75% |
| Propanol | 9% |
| Butanol | 7% |
| Pentanol | 5% |
| Hexanol & Higher | 4% |

In one aspect, one, several or all of these alcohols are made by a process of the invention using an enzyme of the invention, and the process can further comprise a biomass-to-liquid technology, e.g., a gasification process to produce syngas followed by catalytic synthesis, or by a bioconversion of biomass to a mixed alcohol fuel.

The invention also provides processes comprising use of an enzyme of the invention incorporating (or, incorporated into) "gas to liquid", or GTL; or "coal to liquid", or CTL; or "biomass to liquid" or BTL; or "oilsands to liquid", or OTL, processes; and in one aspect these processes of the invention are used to make synthetic fuels. In one aspect, one of these processes of the invention comprises making a biofuel (e.g., a synfuel) out of a biomass using, e.g., the so-called "Fischer Tropsch" process (a catalyzed chemical reaction in which carbon monoxide and hydrogen are converted into liquid hydrocarbons of various forms; typical catalysts used are based on iron and cobalt; the principal purpose of this process is to produce a synthetic petroleum substitute for use as synthetic lubrication oil or as synthetic fuel). In one aspect, this synthetic biofuel of the invention can contain oxygen and can be used as additive in high quality diesel and petrol.

In alternative aspects, the processes of the invention use various pretreatments, which can be grouped into three categories: physical, chemical, and multiple (physical+chemical). Any chemicals can be used as a pretreatment agent, e.g., acids, alkalis, gases, cellulose solvents, alcohols, oxidizing agents and reducing agents. Among these chemicals, alkali is the most popular pretreatment agent because it is relatively inexpensive and results in less cellulose degradation. The common alkalis sodium hydroxide and lime also can be used as pretreatment agents. Although sodium hydroxide increases biomass digestibility significantly, it is difficult to recycle, is relatively expensive, and is dangerous to handle. In contrast, lime has many advantages: it is safe and very inexpensive, and can be recovered by carbonating wash water with carbon dioxide.

In one aspect, the invention provides a multi-enzyme system (including at least one enzyme of this invention) that can hydrolyze polysaccharides in a biomass, e.g. sugarcane, e.g., bagasse, a component of sugarcane processed in sugar mills. In one aspect, the biomass is processed by an enzyme of the invention made by an organism (e.g., transgenic animal, plants, transformed microorganism) and/or byproduct (e.g., harvested plant, fruit, seed) expressing an enzyme of the invention. In one aspect, the enzyme is a recombinant enzyme made by the plant or biomass which is to be processed to a fuel, e.g., the invention provides a transgenic sugarcane bagasse comprising an enzyme of the invention. In one aspect, these compositions and products used in methods of the invention comprising chemical cycles for natural biomass conversion, e.g., for the hydrolysis of a biomass to make a biofuel, e.g., bioethanol, biopropanol, bio-butanol, biomethanol, a synthetic fuel in the form of a liquid or a gas, such as a "syngas".

In one aspect, the invention provides a biofuel, e.g., a biogas, produced by the process of anaerobic digestion of organic material by anaerobes, wherein the process comprises use of an enzyme of the invention or a method of the invention. This biofuel, e.g., a biogas, can be produced either from biodegradable waste materials or by the use of energy crops fed into anaerobic digesters to supplement gas yields. The solid output, digestate, can also be used as a biofuel.

In one aspect, the invention provides a biofuel, e.g., a biogas, comprising a methane, wherein the process comprises use of an enzyme of the invention or a method of the invention. This biofuel, e.g., a biogas, can be recovered in industrial anaerobic digesters and mechanical biological treatment systems. Landfill gas can be further processed using an enzyme of this invention or a process of this invention; before processing landfill gas can be a less clean form of biogas produced in landfills through naturally occurring anaerobic digestion. Paradoxically if landfill gas is allowed to escape into the atmosphere it is a potent greenhouse gas.

The invention provides methods for making biologically produced oils and gases from various wastes, wherein the process comprises use of an enzyme of the invention or a method of the invention. In one aspect, these methods comprise thermal depolymerization of waste to extract methane and other oils similar to petroleum; or, e.g., a bioreactor system that utilizes nontoxic photosynthetic algae to take in smokestacks flue gases and produce biofuels such as biodiesel, biogas and a dry fuel comparable to coal, e.g., as designed by GreenFuel Technologies Corporation, of Cambridge, Mass.

The invention provides methods for making biologically produced oils, including crude oils, and gases that can be used in diesel engines, wherein the process comprises use of an enzyme of the invention or a method of the invention. In one aspect, these methods can refine petroleum, e.g., crude oils, into kerosene, pertroleum, diesel and other fractions.

The invention provides methods (using an enzyme of the invention or a method of the invention) for making biologically produced oils from:

Straight vegetable oil (SVO).

Waste vegetable oil (WVO)—waste cooking oils and greases produced in quantity mostly by commercial kitchens.

Biodiesel obtained from transesterification of animal fats and vegetable oil, directly usable in petroleum diesel engines.

Biologically derived crude oil, together with biogas and carbon solids via the thermal depolymerization of complex organic materials including non oil based materials; for example, waste products such as old tires, offal, wood and plastic.

Pyrolysis oil; which may be produced out of biomass, wood waste etc. using heat only in the flash pyrolysis process (the oil may have to be treated before using in conventional fuel systems or internal combustion engines).

Wood, charcoal, and dried dung.

Medical and Research Applications

Xylanases of the invention, including the enzyme mixtures or "cocktails" of the invention, can be used as antimicrobial agents due to their bacteriolytic properties. Xylanases of the invention can be used to eliminating or protecting animals from salmonellae, as described in e.g., PCT Application Nos. WO0049890 and WO9903497. In another aspect of the invention, the xylanases of the invention can also be used an antimicrobial surface cleanser or microbial repellent.

Other Industrial and Medical Applications

As discussed above, xylanases of the invention, including the enzyme mixtures or "cocktails" of the invention, can be used can be used, e.g., in a wide variety of industrial processes, medical and research (laboratory) applications, and food, animal feed and beverage applications. New xylanases are discovered by screening existing libraries and DNA libraries constructed from diverse mesophilic and moderately thermophilic locations as well as from targeted sources including digestive flora, microorganisms in animal waste, soil bacteria and highly alkaline habitats. Biotrap and primary enrichment strategies using arabinoxylan substrates and/or non-soluble polysaccharide fractions of animal feed material are also useful.

Two screening formats (activity-based and sequence-based) are used in the discovery of novel xylanases. The activity-based approach is direct screening for xylanase activity in agar plates using a substrate such as azo-xylan (Megazyrne). Alternatively a sequence-based approach may be used, which relies on bioinformatics and molecular biology to design probes for hybridization and biopanning. See, for example, U.S. Pat. Nos. 6,054,267, 6,030,779, 6,368,798, 6,344,328. Hits from the screening are purified, sequenced, characterized (for example, determination of specificity, temperature and pH optima), analyzed using bioinformatics, subcloned and expressed for basic biochemical characterization. These methods may be used in screening for xylanases useful in a myriad of applications, including dough conditioning and as animal feed additive enzymes.

In characterizing enzymes obtained from screening, the exemplary utility in dough processing and baking applications may be assessed. Characterization may include, for example, measurement of substrate specificity (xylan, arabinoxylan, CMC, BBG), temperature and pH stability and specific activity. A commercial enzyme may be used as a benchmark. In one aspect, the enzymes of the invention have significant activity at pH 7 and 25-35° C., are inactive on insoluble xylan, are stable and active in 50-67% sucrose.

In another aspect, utility as feed additives may be assessed from characterization of candidate enzymes. Characterization may include, for example, measurement of substrate specificity (xylan, arabinoxylan, CMC, BβG), temperature and pH stability, specific activity and gastric stability. In one aspect the feed is designed for a monogastric animal and in another aspect the feed is designed for a ruminant animal. In one aspect, the enzymes of the invention have significant activity at pH 2-4 and 35-40° C., a half-life greater than 30 minutes in gastric fluid, formulation (in buffer or cells) half-life greater than 5 minutes at 85° C. and are used as a monogastric animal feed additive. In another aspect, the enzymes of the invention have one or more of the following characteristics: significant activity at pH 6.5-7.0 and 35-40° C., a half-life greater than 30 minutes in rumen fluid, formulation stability as stable as dry powder and are used as a ruminant animal feed additive.

Enzymes are reactive toward a wide range of natural and unnatural substrates, thus enabling the modification of virtually any organic lead compound. Moreover, unlike traditional chemical catalysts, enzymes are highly enantio- and regio-selective. The high degree of functional group specificity exhibited by enzymes enables one to keep track of each reaction in a synthetic sequence leading to a new active compound. Enzymes are also capable of catalyzing many diverse reactions unrelated to their physiological function in nature. For example, peroxidases catalyze the oxidation of phenols by hydrogen peroxide. Peroxidases can also catalyze hydroxylation reactions that are not related to the native function of the enzyme. Other examples are xylanases which catalyze the breakdown of polypeptides. In organic solution some xylanases can also acylate sugars, a function unrelated to the native function of these enzymes.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds. Each biocatalyst is specific for one functional group, or several related functional groups and can react with many starting compounds containing this functional group. The biocatalytic reactions produce a population of derivatives from a single starting compound. These derivatives can be subjected to another round of biocatalytic reactions to produce a second population of derivative compounds. Thousands of variations of the original compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so-called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods. (For further teachings on modification of molecules, including small molecules, see PCT/US94/09174).

In one aspect, the invention provides a composition comprising at least one mucoadhesive polymer that is capable of forming a hydrogel and at one least water soluble polymer, and one or more enzymes of the invention. This formulation can be used in any industrial, food or feed processing or medical or research application of the invention, i.e., any application using an enzyme or nucleic acid of the invention. In one aspect, the formulation forms a hydrogel in aqueous solution that has mucoadhesive properties; this can be capable of releasing enzymes, microorganisms capable of generating enzymes of the invention, or antibodies of the invention, over an extended period of time. Alternatively, the hydrogel can entrap enzymes, microorganisms capable of generating enzymes of the invention, or antibodies of the invention and release them over a defined (e.g., an extended) period of time.

The invention will be further described with reference to the following examples; however, it is to be understood that the invention is not limited to such examples.

EXAMPLES

Example 1

Plate Based Endoglycosidase Enzyme Discovery: Expression Screening

Titer determination of Lambda Library: Add 1.0 µL of Lambda Zap Express amplified library stock to 600 µL E. coli MRF' cells ($OD_{600}$=1.0). Dilute MRF' stock with 10 mM $MgSO_4$. Incubate mixture at 37° C. for 15 minutes, then transfer suspension to 5-6 mL of NZY top agar at 50° C. and gently mix. Immediately pour agar solution onto large (150 mm) NZY media plate and allow top agar to solidify completely (approximately 30 minutes). Invert the plate. Incubate the plate at 39° C. for 8-12 hours. (The number of plaques is approximated. Phage titer determined to give 50,000 pfu/plate. Dilute an aliquot of Library phage with SM buffer if needed.)

Substrate screening: Add Lambda Zap Express (50,000 pfu) from amplified library to 600 µL of E. Coli MRF' cells ($OD_{600}$=1.0) and incubate at 37° C. for 15 minutes. While phage/cell suspension is incubating, add 1.0 mL of desired polysaccharide dye-labeled substrate (usually 1-2% w/v) to 5.0 mL NZY top agar at 50° C. and mix thoroughly. (Solution kept at 50° C. until needed.) Transfer the cell suspension to substrate/top agar solution and gently mix. Immediately pour solution onto large (150 mm) NZY media plate. Allow top agar to solidify completely (approximately 30 minutes), then invert plate. Incubate plate at 39° C. for 8-12 hours. Observe plate for clearing zones (halos) around plaques. Core plaques with halos out of agar and transfer to a sterile micro tube. (A large bore 200 µL pipette tip works well to remove (core) the agar plug containing the desired plaque.) Resuspend phage in 500 µL SM buffer. Add 20 µL chloroform to inhibit any further cell growth.

Isolation of pure clones: Add 5 µL of resuspended phage suspension to 500 µL of E. coli MRF' cells ($OD_{600}$=1.0). Incubate at 37° C. for 15 minutes. While phage/cell suspension is incubating, add 600 µL of desired polysaccharide dye-labeled substrate (usually 1-2% w/v) to 3.0 mL NZY top agar at 50° C. and mix thoroughly. (Solution kept at 50° C. until needed.) Transfer cell suspension to substrate/top agar solution and gently mix. Immediately pour solution onto small (90 mm) NZY media plate and allow top agar to solidify completely (approximately 30 minutes), then invert plate. Incubate plate at 39° C. for 8-12 hours. Plate observed for a clearing zone (halo) around a single plaque (pure clone). (If a single plaque cannot be isolated, adjust titer and replate phage suspension.) Phage are resuspended in 500 µL SM buffer and 20 µL Chloroform is added to inhibit any further cell growth.

Excision of pure clone: Allow pure phage suspension to incubate at room temperature for 2 to 3 hours or overnight at 4° C. Add 100 µL of pure phage suspension to 200 µL E. coli MRF' cells ($OD_{600}$=1.0). Add 1.0 µL of ExAssist helper phage (>1×10$^6$ pfu/mL; Stratagene). Incubate suspension at 37° C. for 15 minutes. Add 3.0 mL of 2×YT media to cell suspension. Incubate at 37° C. for 2-2.5 hours while shaking. Transfer tube to 70° C. for 20 minutes. Transfer 50-100 µL of phagemid suspension to a micro tube containing 200 µL of E. coli Exp 505 cells ($OD_{600}$=1.0). Incubate suspension at 37° C. for 45 minutes. Plate 100 µL of cell suspension on $LB_{kan\ 50}$ media (LB media with Kanamycin 50 µg/mL). Incubate plate at 37° C. for 8-12 hours. Observe plate for colonies. Any colonies that grow contain the pure phagemid. Pick a colony and grow a small (3-10 mL) liquid culture for 8-12 hours. Culture media is liquid $LB_{kan\ 50}$.

Activity verification: Transfer 1.0 mL of liquid culture to a sterile micro tube. Centrifuge at 13200 rpm (16000 g's) for 1 minute. Discard supernatant and add 200 µL of phosphate buffer pH 6.2. Sonicate for 5 to 10 seconds on ice using a micro tip. Add 200 µL of appropriate substrate, mix gently and incubate at 37° C. for 1.5-2 hours. A negative control should also be run that contains only buffer and substrate. Add 1.0 mL absolute ethanol (200 proof) to suspension and mixed. Centrifuge at 13200 rpm for 10 minutes. Observe supernatant for color. Amount of coloration may vary, but any tubes with more coloration than control is considered positive for activity. A spectrophotometer can be used for this step if so desired or needed. (For azo-xylan, Megazyme, read at 590 nm).

RFLP of pure clones from same Libraries: Transfer 1.0 mL of liquid culture to a sterile micro tube. Centrifuge at 13200 rpm (16000 g's) for 1 minute. Follow QIAprep spin mini kit (Qiagen) protocol for plasmid isolation and use 40 μL holy water as the elution buffer. Transfer 10 μL plasmid DNA to a sterile micro tube. Add 1.5 μL Buffer 3 (New England Biolabs), 1.5 μL 100×BSA solution (New England Biolabs) and 2.0 μL holy water. To this add 1.0 μL Not 1 and 1.0 μL Pst 1 restriction endonucleases (New England Biolabs). Incubate for 1.5 hours at 37° C. Add 3.0 μL 6× Loading buffer (Invitrogen). Run 15 μL of digested sample on a 1.0% agarose gel for 1-1.5 hours at 120 volts. View the gel with a gel imager. Perform sequence analysis on all clones with a different digest pattern.

Table 6 describes various properties of exemplary enzymes of the invention.

TABLE 6

| SEQ ID NO. | Topt* | Tstab** | pHopt* | Significant activities | pI | M$_w$ | Notes |
|---|---|---|---|---|---|---|---|
| 151, 152 | 50° C. | <1 min at 65° C. | 5.5-9.0 | AZO-xylan | 5.7 | 40.2 | |
| 155, 156 | 50° C. | <1 min at 65° C. | 5.5-8.0 | AZO-xylan | 8.8 | 62.7 | |
| 169, 170 | 50° C. | >1 min at 65° C.; <1 min at 85° C. | 7.0 | AZO-xylan | 8.7 | 36.7 | |
| 195, 196 | 50° C. | >1 min at 65° C. <10 min, <1 min 85° C. | 5.5 | AZO-xylan | 8.5 | 36.7 | |
| 215, 216 | 85° C. | <3 min at 85° C. | 5.5-8.0 | AZO-xylan | 8.6 | 34.8 | |
| 47, 48 | 50° C. | <0.5 min at 65° C.; <1 min at 85° C. | 7.0-8.0 | AZO-xylan | 6.2 | 40.3 | |
| 191, 192 | ³85° C. | >30 sec at 85° C. | 5.5 | AZO-xylan | 7.8 | 34.6 | |
| 247, 248 | 50° C. | <1 min at 65° C. | 8.0 | AZO-xylan | 9.4 | 43.5 | |
| 7, 8 | 50° C. | >1 min 85° C. <5 min | 5.5 | AZO-xylan | 4.5 | 55.3 | |
| 221, 222 | 50-65° C. | <1 min at 75° C. | 5.5 | AZO-xylan | 8.3 | 34.6 | |
| 163, 164 | 65° C. | <1 min at 65° C. | 7.0 | AZO-xylan | 6.3 | 36.0 | |
| 19, 20 | 37° C. | <5 min at 50° C. | 7.0-8.0 | AZO-xylan | 9.2 | 41.5 | |
| 87, 88 | 37-50° C. | <1 min at 85° C. | 8.0 | AZO-xylan | 5.2 | 36.7 | |
| 81, 82 | 50° C. | <1 min at 65° C. | 7.0-9.0 | AZO-xylan | 5.3 | 38.8 | |
| 91, 92 | 50° C. | <1 min at 65° C. | 7-8 | AZO-xylan, AZO-CMC | 5.4 | 39.0 | |
| 61, 62 | 37° C. | <5 min at 50° C. | 7.0-9.0 | AZO-xylan, AZO-CMC | 5.4 | 40 | |
| 159, 160 | 85° C. | <30 sec at 85° C. | 5.5 | AZO-xylan | 8.3 | 34.5 | |
| 233, 234 | 50° C. | >30 sec <1 min at 65° c.; <1 min at 85° C. | 7.0 | AZO-xylan | 8.5 | 35.1 | |
| 203, 204 | 50-65° C. | >1 min at 65° C. <5 min, <1 min 85° C. | 5.5 | AZO-xylan | 9.5 | 21.7 | |
| 181, 182 | ³85° C. | >1 min at 85° C. | 5.5-8.0 | AZO-xylan | 8.8 | 35.5 | |
| 227, 228 | 65° C. | >1 min at 85° C. <5 min | 5.5-7.0 | AZO-xylan | 7.8 | 25.8 | |
| 45, 46 | ³45° C. | ³5 min 45° C., <0.5 min 55° C. | >5.5 | AZO-xylan | 6.7 | 40.4 | *** |
| 231, 232 | 65° C. | >10 min at 50° C. | 5.5-7.0 | AZO-xylan | 8.4 | 31.4 | |
| 129, 130 | 65° C. | <1 min at 75° C. | 5.5 | AZO-xylan | 5.1 | 116 | |
| 93, 94 | 50° C. | <1 min at 60° C. | 8.0-9.0 | AZO-xylan | 5.3 | 39.1 | |
| 189, 190 | 65° C. | <1 min at 65° C. | 5.5 | AZO-xylan | 9.2 | 20.3 | **** |
| 49, 50 | 70° C. | <20 min 70° C. | >5 | AZO-xylan | 5.7 | 38.9 | |
| 85, 86 | 50° C. | >5 min at 85° C. | 5.5-7.0 | AZO-xylan | 6.1 | 48.4 | |
| 99, 100 | 50° C. | <1 min at 75° C. | 5.5-8.0 | AZO-xylan | 10.8 | 36.6 | |
| 123, 124 | ³85° C. | <30 sec 100° C. | 5.5-7.0 | AZO-xylan | 6.1 | 44.1 | |
| 249, 250 | 45° C. | >1 min 75° C. <10 min | 5.5 | AZO-xylan | 5.3 | 93 | |
| 167, 168 | 85° C. | <5 min 85° C. | 5.5 | AZO-xylan | 9.5 | 21.7 | |
| 207, 208 | 75° C. | <5 min 65° C. | 5.5 | AZO-xylan | 9.1 | 20.4 | |
| 251, 252 | 65-75° C. | <1 min 85° C. | 5.5 | AZO-xylan | 8.8 | 20.4 | ***** |
| 11, 12 | <90° C. | <40 min 70° C. | >6 | AZO-xylan | 6.8 | 43.9 | |
| 177, 178 | 65° C. | <1 min at 75° C. | 5.5 | AZO-xylan | 8.7 | 44.6 | |
| 9, 10 | 50° C. | <1 min at 65° C. | 5.5-7.0 | AZO-xylan | 4.9 | 46.1 | |
| 43, 44 | 37° C. | unstable | 5.5-7.0 | AZO-xylan | 4.9 | 39.1 | |
| 113, 114 | 65-75° C. | <1 min at 75° C. | 5.5-8.0 | AZO-xylan | 5 | 41.2 | |
| 75, 76 | 50° C. | <1 min 85° C. | 7.0-9.0 | AZO-xylan | 4.7 | 39.4 | |
| 111, 112 | 37° C. | >10 min 50° C. | 7-8 | AZO-xylan | 5.6 | 41.0 | |
| 117, 118 | 37° C. | unstable | 7-8 | AZO-xylan | 9.1 | 53.3 | |
| 115, 116 | — | — | — | AZO-xylan | 8.9 | 50.8 | |
| 125, 126 | 37° C. | — | 8.0 | AZO-xylan | 5.3 | 41.1 | |
| 137, 138 | 50° C. | <30 sec at 65° C. | 5.5 | AZO-xylan | 5.7 | 38.5 | |
| 69, 70 | ³85° C. | <5 min at 85° C. | 5.5-9.0 | AZO-xylan | 6.4 | 58.0 | |
| 205, 206 | 50° C. | <1 min at 65° C. | 5.5-8 | AZO-xylan | 4.3 | 35.1 | |
| 211, 212 | 50° C. | <1 min at 65° C. | 5.5 | AZO-xylan | 4.4 | 35.4 | |
| 197, 198 | 65° C. | <1 min at 65° C. | 5.5 | AZO-xylan | 8.8 | 20.1 | |
| 31, 32 | 37° C. | unstable | 7.0 | AZO-xylan | 5.1 | 54.4 | |
| 13, 14 | 50° C. | <1 min at 65° C. | 7 | AZO-xylan | 5.5 | 40.0 | |
| 65, 66 | 50° C. | <1 min at 65° C. | 5.5 | AZO-xylan, AZO-CMC | 4.8 | 55.5 | |

TABLE 6-continued

| SEQ ID NO. | Topt* | Tstab** | pHopt* | Significant activities | pI | $M_w$ | Notes |
|---|---|---|---|---|---|---|---|
| 257, 258 | 37° C. | unstable | 5.5 | AZO-xylan, AZO-barley β-glucan, AZO-CMC | 5.3 | 100.8 | |
| 57, 58 | 50° C. | <1 min at 65° C. | 7.0 | AZO-xylan | 4.8 | 56.7 | |
| 185, 186 | 50-75° C. | <1 min at 80° C. | 5.5 | AZO-xylan | 8.8 | 23.2 | |
| 243, 244 | 75° C. | >0.5 min @ 85° C. | 5.5 | AZO-xylan | 8.8 | 44.4 | |
| 77, 78 | 50° C. | <5 min at 65° C., <1 min 85° C. | 5.5 | AZO-xylan | 5.3 | 44.5 | |
| 229, 230 | 37° C. | ³30 min 55° C., <5 min 75° C. | 5.5 | AZO-xylan | 8.7 | 20.6 | ****** |
| 109, 110 | 65° C. | >0.5 min @ 75° C. | 5.5 | AZO-xylan | 4.9 | 45.2 | |
| 193, 194 | 65° C. | <1 min at 75° C. | 5.5 | AZO-xylan | 5.4 | 29.1 | |
| 173, 174 | 65° C. | <1 min at 80° C. | 7.0 | AZO-xylan | 7.6 | 51.6 | |
| 59, 60 | 37° C. | <1 min at 65° C. | 7.0 | AZO-xylan | 6.6 | 42.5 | |
| 101, 102 | 50° C. | >0.5 min @ 65° C. | 7.0 | AZO-xylan | 8.7 | 41.1 | |
| 55, 56 | 37° C. | >5 min at 50° C.; <1 min at 85° C. | 7.0 | AZO-xylan | 6.5 | 41.8 | |
| 15, 16 | 50° C. | <1 min at 65° C. | 7.0 | AZO-xylan | 6.4 | 40.2 | |
| 131, 132 | — | — | — | AZO-xylan | 5.6 | 42.1 | |
| 145, 146 | 65-85° C. | <1 min at 85° C. | 5.5 | AZO-xylan | 5.2 | 43.7 | |
| 219, 220 | — | — | 5.5 | AZO-xylan | 6.6 | 34.5 | |
| 253, 254 | 65° C. | >.5 min at 85° C. | 5.5-7 | AZO-xylan | 7.8 | 34.6 | |
| 255, 256 | 65° C. | >1 min 65° C. <3 min | 5.5-7.0 | AZO-xylan | 8.3 | 35.0 | |

*pH or temperature optima determined by initial rates using AZO-AZO-xylan as a substrate
**thermal stability, time that enzyme retained significant activity (approx. >50%)
*** Dough conditioning
**** GSSM parent for thermal tolerance evolution for animal feed applications
***** N35D mutation made to increase low pH activity-based on public knowledge-mutant enzyme's relative activity at pH 4 significantly increased
****** Dough conditioning Example 2

GSSM Screen for Thermal Tolerant Mutants

The following example describes an exemplary method for screening for thermally tolerant enzymes.

Master Plates Prepare plates for a colony picker by labeling 96 well plates and aliquoting 200 µL LB Amp100 into each well. (~20 ml needed per 96 well plate). After the plates are returned from the picker, remove media from row 6 from plate A. Replace with an inoculation of SEQ ID NO:189. Place in a humidified 37° C. incubator overnight.

Assay Plates: Pin tool cultures into a fresh 96 well plate (200 µL/well LB Amp100). Remove plastic cover and replace with Gas Permeable Seal. Place in a humidified incubator overnight. Remove the seal and replace plastic lid. Spin cultures down in tabletop centrifuge at 3000 rpm for 10 min. Remove supernatant by inversion onto a paper towel. Aliquot 45 µL Cit-Phos-KCl buffer pH 6 into each well. Replace the plastic lid with an aluminum plate seal. Use a roller to get a good seal. Resuspend cells in a plate shaker at level 6-7 for 30 seconds.

Place the 96 well plate in 80° C. incubator for 20 minutes. Do not stack. Thereafter, immediately remove plates to ice water to cool for a few minutes. Remove the aluminum seal and replace with a plastic lid. Add 30 µL of 2% Azo-xylan. Mix as before on the plate shaker. Incubate 37° C. in a humidified incubator overnight.

Add 200 µL ethanol to each well and pipette up and down a couple of times to mix. As an alternative to changing tips each time, rinse in an ethanol wash and dry by expelling into a paper towel. Spin the plates at 3000 rpm for 10 minutes. Remove 100 µL of supernatant to a fresh 96 well plate. Read the $OD_{590}$.

Example 3

GSSM Assay for Hit Verification of Thermal Tolerant Mutants

The following example describes an exemplary method for assaying for thermally tolerant enzymes.

Pin tool or pick clones into duplicate 96 well plates (200 ul/well LB Amp100). Remove the plastic cover and replace with a Gas Permeable Seal. Place in a humidified incubator overnight. Remove the Seal and replace with a plastic lid. Pintool the clones to solid agar. Spin cultures down in tabletop centrifuge at 3000 rpm for 10 min. Remove the supernatant by inversion onto a paper towel. Aliquot 25 µl BPER/Lysozyme/DNase solution (see below) into each well. Resuspend cells in a plate shaker on level 6-7 for ~30 seconds.

Incubate the plate on ice for 15 minutes. Add 20 µL of Cit-Phos-KCl buffer pH 6 into each well. Replace the plastic lid with an aluminum plate seal. Use a roller to get a good seal. Mix on a plate shaker at level 6-7 for ~30 seconds.

Place one 96 well plate in an 80° C. incubator for 20 minutes and the other at 37° C. Do not stack. Immediately remove the plates to watery ice to cool for a few minutes (use a large plastic tray if needed). Remove the aluminum seal. Add 30 µl of 2% Azo-xylan. Seal with a plastic gas permeable seal. Mix as before on the plate shaker. Incubate a set of 37° C. and 80° C. plates in humidified incubator at 37° C. for 2 hours and another set for 4 hours.

After incubation, let the plate sit for 5 minutes at room temperature. Add 200 µL ethanol to each well and pipette up and down a couple of times to mix. Instead of changing tips each time, rinse in an ethanol wash and dry by expelling into a paper towel. But, use a new set of tips for each clone. Spin plates at 3000 rpm 10 minutes. Remove 100 µL of supernatant to a fresh 96 well plate. Read $OD_{590}$.

BPER/Lysozyme/DNase solution (4.74 mL total):
4.5 mL BPR
200 µL 10 mg/mL Lysozyme (made fresh in pH 6 Cit-phos-buffer)
40 µL 5 mg/mL DNase I (made fresh in pH 6 Cit-phos buffer)

Example 4

Xylanase Assay with Wheat Arabinoxylan as Substrate

The following example describes an exemplary xylanase assay that can be used, for example, to determine is an enzyme is within the scope of the invention.

SEQ ID NOS: 11, 12, 69, 70, 77, 78, 113, 114, 149, 150, 159, 160, 163, 164, 167, 168, 181, 182, 197, and 198 were subjected to an assay at pH 8 (Na-phosphate buffer) and 70° C. using wheat arabinoxylan as a substrate. The enzymes were characterized as set forth in Table 7.

TABLE 7

| SEQ ID NOS: | Protein Concentration (mg/ml) | volume of lysate added to each vial | #of vials | Units/ml* | protein (mg/mL) | U/mg |
| --- | --- | --- | --- | --- | --- | --- |
| 11, 12 | 42 | 0.5 | 10 | 163 | 22.0 | 7.4 |
| 113, 114 | 37 | 0.6 | 10 | 66 | 22.0 | 3.0 |
| 163, 164 | 35 | 0.6 | 10 | 25 | 22.0 | 1.1 |
| 197, 198 | 23 | 1.0 | 10 | 31 | 22.0 | 1.4 |
| 167, 168 | 10 | 2.2 | 10 | 228 | 22.0 | 10.4 |
| 77, 78 | 47 | 0.5 | 10 | 29 | 22.0 | 1.3 |
| 69, 70 | 18 | 1.3 | 10 | 36 | 22.0 | 1.7 |
| 181, 182 | 28 | 0.8 | 10 | 24 | 22.0 | 1.1 |
| 159, 160 | 25 | 0.9 | 10 | 43 | 22.0 | 2.0 |
| 149, 150 | 42 | 0.5 | 10 | 24 | 22.0 | 1.1 |

*Based on addition of 1 mL of water to each sample.
Units are umoles xylose released per minute based on a reducing sugar assay.

Example 5

Generation of an Exemplary Xylanase of the Invention

The following example describes the generation of an exemplary xylanase of the invention using gene site-saturation mutagenesis (GSSM) technology, designated the "9X" variant or mutant (the nucleic acid as set forth in SEQ ID NO:377, the polypeptide sequence as set forth in SEQ ID NO:378).

GSSM was used to create a comprehensive library of point mutations in the exemplary SEQ ID NO:190, "wild-type" xylanase (encoded by SEQ ID NO:189). The xylanase thermotolerance screen described above identified nine single site amino acid mutants (FIG. 6A) (D8F, Q11H, N12L, G17I, G60H, P64V, S65V, G68A & S79P) that had improved thermal tolerance relative to the wild type enzyme (as measured following a heat challenge at 80° C. for 20 minutes). Wild-type enzyme and all nine single site amino acid mutants were produced in E. coli and purified utilizing an N-terminal hexa-histidine tag. There was no noticeable difference in activity due to the tag.

Figure 6:
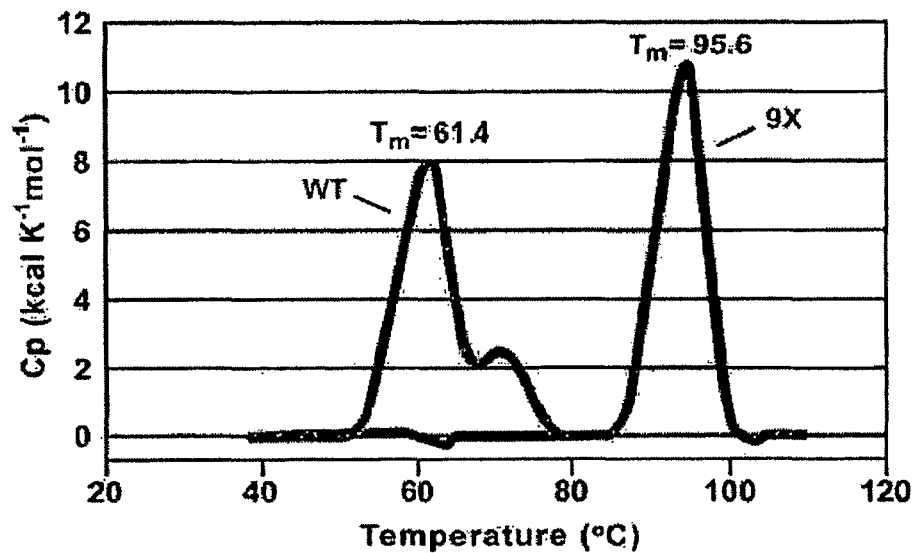
FIG. 6A illustrates the nine single site amino acid mutants of SEQ ID NO:378 (encoded by SEQ ID NO:377) as generated by Gene Site Saturation Mutagenesis (GSSM) of SEQ ID NO:190 (encoded by SEQ ID NO:189), as described in detail in Example 5, below.
FIG. 6B illustrates the unfolding of SEQ ID NO:190 and SEQ ID NO:378 in melting temperature transition midpoint (Tm) experiments as determined by Differential Scanning Calorimetry (DSC) for each enzyme, as described in detail in Example 5, below.

FIG. 6 illustrates the nine single site amino acid mutants of "variant 9X", or, as set forth in SEQ ID NO:378 (encoded by SEQ ID NO:377), as generated by Gene Site Saturation Mutagenesis (GSSM) of the exemplary SEQ ID NO:190 "wild-type" enzyme (encoded by SEQ ID NO:189). FIG. 6A is a schematic diagram illustrating position, numbering and the amino acid change for the thermal tolerant point mutants of the "wild-type" gene (SEQ ID NO:190, encoded by SEQ ID NO:189). A library of all 64 codons was generated for every amino acid position in the gene (~13,000 mutants) and screened for mutations that increased thermal tolerance. The "9X" variant was generated by combining all 9 single-site mutants into one enzyme. The corresponding melting temperature transition midpoint ($T_m$) determined by Differential Scanning Calorimetry (DSC) for each mutant enzyme and the "9X" (SEQ ID NO:378) variant is shown on the right. FIG. 6B illustrates the unfolding of the "wild-type" (SEQ ID NO:190) and "9X" (SEQ ID NO:378) "variant/mutant" enzymes was monitored by DSC at a scan rate of 1° C./min. Baseline subtracted DSC data were normalized for protein concentration.

DSC measurements were made using a VP-DSC microcalorimeter (Micro-Cal) in duplicate. The required sample volume was 540 µL. The concentrations of the protein were between 0.1 to 0.5 mg/mL in 50 mM HEPES, pH 7.2 and the dialysis buffer was retained for base line controls. Each sample was heated from 40° C. to 110° C. Samples and/or buffer were heated and cooled at a scan rate of 90° C./h. Buffer baselines were recorded multiple times until the system reached a stable state. The $T_m$ value was the temperature where maximum heat was released.

Xylanase Activity Assays

Enzymatic activities were determined using 400 ∞L of 2% Azo-xylan as substrate in 550 ∞L of CP (citrate-phosphate) buffer, pH 6.0 at the indicated temperatures. Activity measurements as a function of pH were determined using 50 mM Britton and Robinson buffer solutions (pH 3.0, 5.0, 6.0, 7.0, 8.0 and 9.0) prepared by mixing solutions of 0.1 M phosphoric acid solution, 0.1 M boric acid and 0.1 M acetic acid followed by pH adjustment with 1 M sodium hydroxide. Reactions were initiated by adding 50 ∞L of 0.1 mg/ml of purified enzyme. Time points were taken from 0 to 15 minutes where 50 ∞L of reaction mixture was added to 200 ∞L of precipitation solution (100% ethanol). When all time points had been taken, samples were mixed, incubated for 10 minutes and centrifuged at 3000 g for 10 minutes at 4° C. Supernatant (150 ∞L) was aliquoted into a fresh 96 well plate and absorbance was measured at 590 nm. $A_{590}$ values were plotted against time and the initial rate was determined from the slope of the line.

Differential Scanning Calorimetry (DSC).

Calorimetry was performed using a Model 6100 Nano II DSC apparatus (Calorimetry Sciences Corporation, American Fork, Utah) using the DSCRun software package for data acquisition, CpCalc for analysis, CpConvert for conversion into molar heat capacity from microwatts and CpDeconvolute for deconvolution. Analysis was carried out with 1 mg/ml recombinant protein in 20 mM potassium phosphate (pH 7.0) and 100 mM KCl at a scan rate of 1° C./min. A constant pressure of 5 atm was maintained during all DSC experiments to prevent possible degassing of the solution on heating. The instrumental baseline was recorded routinely before the experiments with both cells filled with buffer. Reversibility of the thermally induced transitions was tested by reheating the solution in the calorimeter cell immediately after cooling the first run.

Thermal Tolerance Determination.

All enzymes were analyzed for thermal tolerance at 80° C. in 20 mM potassium phosphate (pH 7.0) and 100 mM KCl. The enzymes were heated at 80° C. for 0, 5, 10 or 30 minutes in thin-walled tubes and were cooled on ice. Residual activities were determined with Azo-xylan as substrate using the assay described above for activity measurement.

Polysaccharide Fingerprinting.

Polysaccharide fingerprints were determined by polysaccharide analysis using carbohydrate gel electrophoresis (PACE). Beechwood xylan (0.1 mg/mL, 100 ∞L, Sigma, Poole, Dorset, UK) or xylooligosaccharides (1 mM, 20 ∞L, Megazyme, Wicklow, Ireland) were treated with enzyme (1-3 ∞g) in a total volume of 250 ∞L for 16 hours. The reaction was buffered in 0.1 M ammonium acetate pH 5.5. Controls without substrates or enzymes were performed under the same conditions to identify any unspecific compounds in the enzymes, polysaccharides/oligosaccharides or labeling reagents. The reactions were stopped by boiling for 20 min. Assays were independently performed at least 2 times for each condition. Derivatization using ANTS (8-aminonaphthalene-1,3,6-trisulfonic acid, Molecular Probes, Leiden, The Netherlands), electrophoresis and imaging were carried out as described (Goubet, F., Jackson, P., Deery, M. and Dupree, P. (2002) *Anal. Biochem.* 300, 53-68).

Fitness Calculation.

The fitness ($F_n$), for a given enzyme variant, n, was calculated by equally weighting increase in denaturation temperature transition midpoint ($T_m$) and increase (or decrease) in enzymatic activity relative to the largest difference in each parameter across all variants: $F_n=F_{Tn}+F_{Vn}$, where $F_{Tn}=T_m$ fitness factor of the variant and $F_{vn}$=activity fitness factor of the variant. The fitness factors for each ($T_m$ and activity) are relative to the largest difference in $T_m$ or rate across all of the variants. $F_{Tn}=(T_m-T_{mL})/(T_{mH}-T_{mL})$ where $T_{mn}$ is the $T_m$ for the given variant, n, and $T_{mL}$ is the lowest $T_m$ across all variants and $T_{mH}$ the highest $T_m$ across all variants and $F_{Vn}=(V_n-V_L)/(V_H-V_L)$ where $V_n$ is the relative rate for the given variant, n, and $V_L$ is the lowest rate across all variants and $V_H$ the highest rate across all variants.

Evolution by the GSSM Method.

GSSM technology was used to create a comprehensive library of point mutations in the exemplary xylanase of the invention SEQ ID NO:190 (encoded by SEQ ID NO:189); including the exemplary xylanase of the invention SEQ ID NO:378 (encoded by SEQ ID NO:377). The xylanase thermotolerance screen described above identified nine single site amino acid mutants (FIG. 6A), D8F, Q11H, N12L, G17I, G60H, P64V, S65V, G68A & S79P, that had improved thermal tolerance relative to the exemplary "wild type" enzyme SEQ ID NO:190 (encoded by SEQ ID NO:189), as measured following a heat challenge at 80° C. for 20 minutes. Wild-type enzyme and all nine single site amino acid mutants were produced in *E. coli* and purified utilizing an N-terminal hexahistidine tag. There was no noticeable difference in activity due to the tag.

To determine the effect of the single amino acid mutations on enzymatic activity, all nine mutants were purified and their xylanase activity (initial rates at the wild-type temperature optimum, 70° C.) was compared to that of the exemplary SEQ ID NO:190 "wild-type" enzyme. Enzyme activities were comparable to wild type (initial rate normalized to 1.0) for D8F, N12L, G17I, G60H, P64V, S65V G68A and S79P mutants (relative initial rates 0.65, 0.68, 0.76, 1.1, 1.0, 1.2, 0.98 and 0.84 respectively) confirming that these mutations do not significantly alter the enzymatic activity. Initial rates were measured 3 or more times and variance was typically less than 10%. In contrast to these eight mutants, a notable reduction in enzymatic activity was observed for the best thermal tolerant, single site mutant, Q11H (relative initial rate 0.35).

Melting Temperature ($T_m$) of "Wild-Type" and Thermal Tolerant Single Site Amino Acid Mutant Enzymes.

The purified SEQ ID NO:190 "wild-type" xylanase and the nine thermal tolerant single site amino acid mutants were analyzed using differential scanning calorimetry (DSC). Aggregation was apparent for the wild-type enzyme as evidenced by a shoulder in the DSC trace for its thermal denaturation, see FIG. 6B. The evolved mutant enzymes showed no indication of aggregation. For all enzymes, thermally induced denaturation was irreversible and no discernible transition was observed in a second scan of the sample. Due to the irreversibility of denaturation, only the apparent $T_m$ (melting temperature) could be calculated (as described, e.g., by Sanchez-Ruiz (1992) *Biophys. J.* 61:921-935; Beldarrain (2000) *Biotechnol. Appl. Biochem.* 31:77-84). The $T_m$ of the wild-type enzyme was 61° C. while the $T_m$'s of all point mutants were increased and ranged from 64° C. to 70° C. (FIG. 6A). The Q11H mutation introduced the largest increase ($T_m=70°$ C.) over wild-type followed by P64V (69° C.), G17I (67° C.) and D8F (67° C.).

The "9X" Combined GSSM Exemplary Enzyme SEQ ID NO:378

The "9X" enzyme (SEQ ID NO:378) was constructed by combining the single-site changes of the nine thermal tolerant up-mutants by site-directed mutagenesis (FIG. 6A). The "9X" (SEQ ID NO:378) enzyme was expressed in *E. coli* and purified to homogeneity. DSC was performed to determine the melting temperature. The $T_m$ of "9X" enzyme was 34 degrees higher than SEQ ID NO:190, the "wild-type" enzyme, demonstrating a dramatic shift in its thermal stability (FIG. 6B).

To evaluate the effect of the combined mutations and elevated melting temperature on the enzyme's biochemical properties, pH and temperature profiles were constructed and compared to SEQ ID NO:190, the "wild-type" enzyme. FIG. 7 illustrates the biochemical characterization of "wild type" and "evolved" 9X mutant enzymes. FIG. 7A illustrates the pH-dependence of activity for the wild-type and evolved 9X mutant enzymes. Xylanase activity was measured at 37° C. at each pH and the initial velocity was plotted against absorbance at 590 mm to determine initial rates. FIG. 7B illustrates the temperature-dependence of activity for the wild-type and evolved 9X mutant enzymes. The optimum temperatures of the wild-type and 9X mutant enzymes were measured over a temperature range of 25-100° C. at pH 6.0 and are based on initial rates measured over 5 minutes. FIG. 7C illustrates the thermal stability of wild-type and evolved 9X mutant enzymes. Thermal dependence of activity of the wild-type and evolved 9X mutant enzymes was measured by first heating the enzymes at each of the indicated temperatures for 5 minutes followed by cooling to room temperature and the measurement of residual activity (initial rate at 37° C., pH 6.0). For all experiments initial rates were measured 2 or more times and the variation was less than 10%.

SEQ ID NO:190 and SEQ ID NO:378 (the "9X" mutant) enzyme had comparable pH/activity profiles with the highest activity between pH 5 and 6 (FIG. 7A). Both enzymes had similar initial rate/temperature optima at 70° C., however, SEQ ID NO:190, the "wild-type" enzyme had higher activity at lower temperatures (25-50° C.) whereas SEQ ID NO:378 (the "9X" mutant) retained more than 60% of its activity up to 100° C. (determined by initial rate) in the presence of substrate (FIG. 7B). The activity of SEQ ID NO:190, the "wild-type" enzyme was not detectable at temperatures above 70° C.

To determine the effect of the 9 combined mutations on enzyme thermal tolerance, residual activity was measured and compared to SEQ ID NO:190, the "wild-type" enzyme. Residual activity was determined by a heat challenge for 5 minutes at each temperature (37, 50, 60, 70, 80 and 90° C.) followed by activity measurements at 37° C. SEQ ID NO:190 was completely inactivated above 70° C. while the evolved 9X mutant displayed significant activity after heating at 70, 80 and even 90° C. (FIG. 7C). Furthermore, although the activity of the wild-type enzyme decreased with increasing temperature, the 9X variant was somewhat activated by heating at temperatures up to 60° C.

Generation of Combinatorial GSSM Variants Using GeneReassembly Technology.

Figure 8:
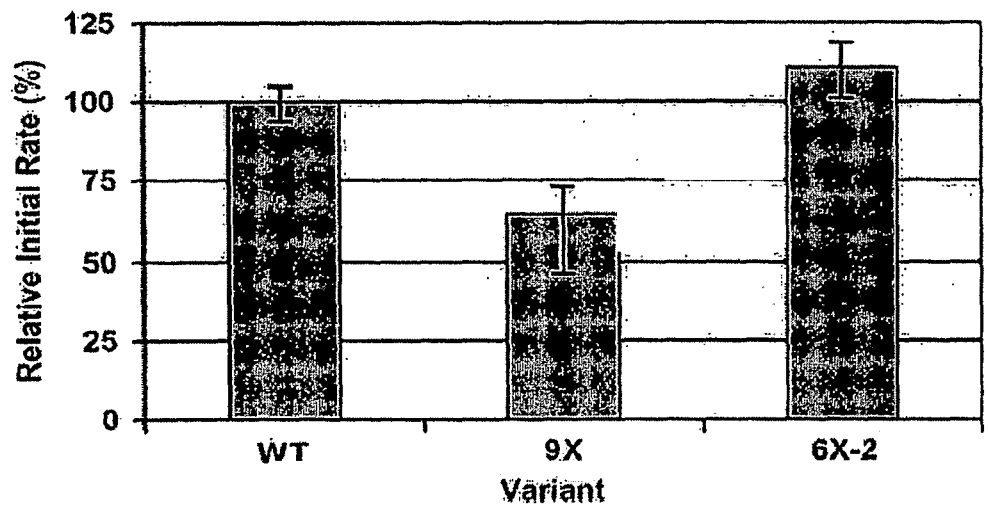
FIG. 8A illustrates the GeneReassembly library of all possible combinations of the 9 GSSM point mutations that was constructed and screened for variants with improved thermal tolerance and activity, as described in detail in Example 5, below.
FIG. 8B illustrates the relative activity of the "6X-2" variant and "9X" variant (SEQ ID NO:378) compared to SEQ ID NO:190 ("wild-type") at a temperature optimum and pH 6.0, as described in detail in Example 5, below.

To identify combinatorial variants of the 9 single site amino acid mutants with highest thermal tolerance and activity compared to the additively constructed SEQ ID NO:378 (the "9X" variant), a GeneReassembly library (U.S. Pat. No. 6,537,776) of all possible mutant combinations (29) was constructed and screened. Using thermal tolerance as the screening criterion, 33 unique combinations of the nine mutations were identified as was the original 9X variant. A secondary screen was performed to select for variants with higher activity/expression than the evolved 9X. This screen yielded 10 variants with sequences possessing between 6 and 8 of the original single mutations in various combinations, as illustrated in FIG. 8A. FIG. 8 illustrates the combinatorial variants identified using GeneReassembly technology. FIG. 8A illustrates the GeneReassembly library of all possible combinations of the 9 GSSM point mutations that was constructed and screened for variants with improved thermal tolerance and activity. Eleven variants including the 9X variant were obtained. As shown in the figure, the variants possessed 6, 7, 8, or 9 of the point mutations in various combinations. The corresponding melting temperature transition midpoint ($T_m$) determined by DSC of each variant is shown on the right. FIG. 8B illustrates the relative activity (initial rate measured over a 5 minute time period) of the 6X-2 and 9X variants compared to wild-type at the temperature optimum (70° C.) and pH 6.0. Error bars show the range in the initial rate for 3 measurements.

The melting temperature ($T_m$) of each of the combinatorial variants was at least 28° C. higher than wild type (FIG. 8A) and all of the reassembly variants displayed higher relative activity than the 9X enzyme. The activity of one variant in particular, 6X-2, was greater than the wild-type enzyme and significantly better (1.7X) than the 9X enzyme (FIG. 8B). Sequence comparison of the reassembly variants identified at least 6 mutations that were required for the enhanced thermostability (>20 degrees) All 33 unique variants found in the initial thermostability screen contained both Q11H and G17I mutations demonstrating their importance for thermal tolerance.

Analysis of Wild-Type and Variant Polysaccharide Product Fingerprints.

Figure 9:
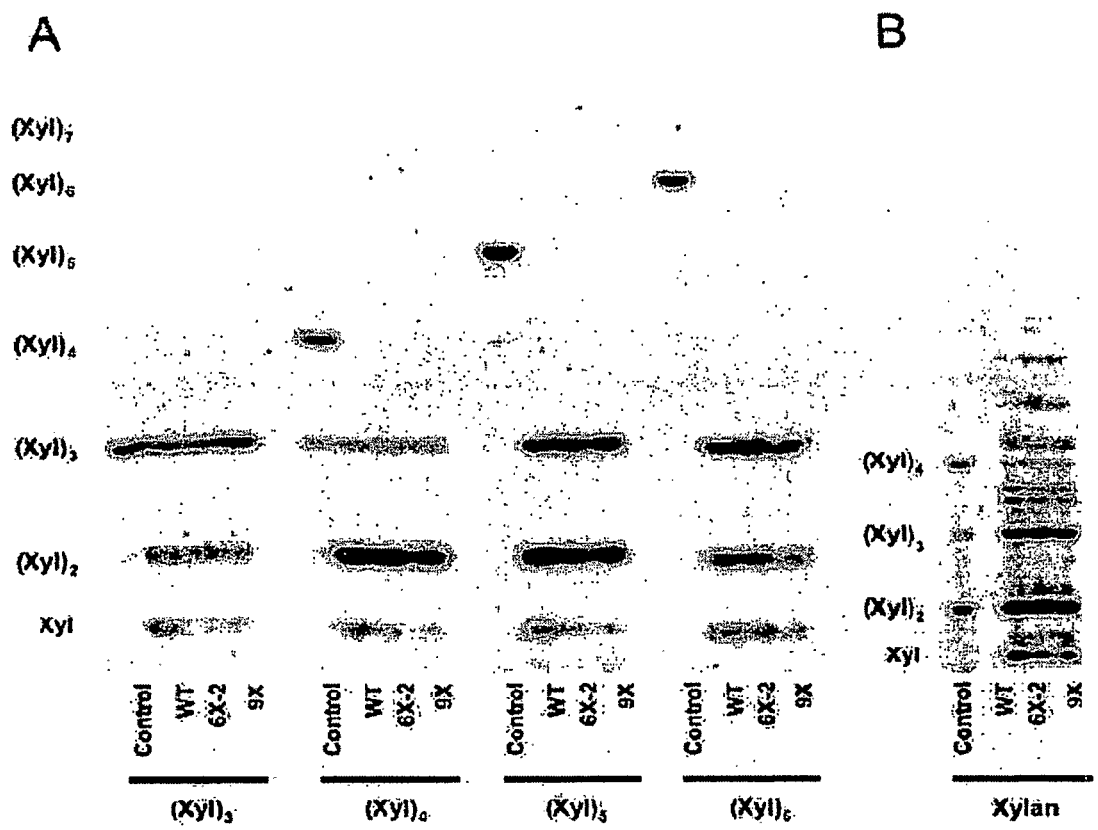
FIG. 9A illustrates the fingerprints obtained after hydrolysis of oligoxylans (Xyl)3, (Xyl)4, (Xyl)5 and (Xyl)6 by the SEQ ID NO:190 ("wild-type") and the "9X" variant (SEQ ID NO:378) enzymes, as described in detail in Example 5, below.
FIG. 9B illustrates the fingerprints obtained after hydrolysis of Beechwood xylan by the SEQ ID NO:190 ("wild-type") and the "9X" variant (SEQ ID NO:378) enzymes, as described in detail in Example 5, below.

The products generated by the "wild-type," 6X-2 and 9X variants were compared by polysaccharide analysis using carbohydrate gel electrophoresis (PACE). Different substrates (oligosaccharides and polysaccharides) were tested for hydrolysis by the xylanases. The digestion products of the 3 xylanases tested were very similar, as illustrated in FIG. 9. All three enzymes hydrolyzed $(Xyl)_6$ and $(Xyl)_5$, mainly into both $(Xyl)_3$ and $(Xyl)_2$, and $(Xyl)_4$ was hydrolyzed to $(Xyl)_2$ (FIG. 9A). Only a small amount of hydrolysis of $(Xyl)_3$ into $(Xyl)_2$ and Xyl was observed indicating that $(Xyl)_3$ is a relatively poor substrate for the enzyme. No activity was detected on $(Xyl)_2$. Beechwood xylan, which contains glucuronosyl residues, was hydrolyzed by all three enzymes mainly into $(Xyl)_2$ and $(Xyl)_3$, but other bands were detected that migrated between oligoxylan bands (FIG. 9B). In PACE analysis, each oligosaccharide has a specific migration depending on the sugar composition and degree of polymerization (Goubet, F., Jackson, P., Deery, M. and Dupree, P. (2002) Anal. Biochem. 300, 53-68), thus, these bands likely correspond to oligoglucuronoxylans. Therefore, the evolved enzymes retained the substrate specificity of the "wild-type" enzyme.

As noted above, FIG. 9 illustrates the product fingerprints of "wild-type" SEQ ID NO:190 (encoded by SEQ ID NO:189), 6X-2 (SEQ ID NO:380, encoded by SEQ ID NO:379) and SEQ ID NO:378 (the "9X" mutant) enzyme variant, as determined by PACE. FIG. 9A illustrates fingerprints obtained after hydrolysis of oligoxylans $(Xyl)_3$, $(Xyl)_4$, $(Xyl)_5$ and $(Xyl)_6$ by "wild-type" and variant enzymes. Control lanes contain oligosaccharide incubated under the assay conditions in the absence of enzyme. FIG. 9B illustrates the fingerprints obtained after hydrolysis of Beechwood xylan by wild-type and variant enzymes. Standards contained $(Xyl)_2$, $(Xyl)_3$, $(Xyl)_4$. All assays were performed at 37° C. and pH 5.5.

A combination of laboratory gene evolution strategies was used to rapidly generate a highly active, thermostable xylanase optimized for process compatibility in a number of industrial market applications. GSSM methodology was employed to scan the entire sequence of the exemplary "wild type" xylanase SEQ ID NO:190 (encoded by SEQ ID NO:189) and to identify 9 point mutations that improve its thermal tolerance. Although it had no discernable effect on the hydrolysis product profile of the enzyme, as illustrated in FIG. 9, the addition of the 9 mutations to the protein sequence resulted in a moderate reduction in enzymatic specific activity at SEQ ID NO:190 (the "wild-type")'s temperature optimum. 70° C., see FIG. 9B. Using the GeneReassembly method to generate a combinatorial library of the 9 single site amino acid mutants, this reduction in activity was overcome. Ten thermostable variants ($T_m$'s between 89° C. and 94° C.) with activity better than the "9X" variant were obtained from screening the GeneReassembly library. With a $T_m$ of 90° C., enzymatic specific activity surpassing wild-type and a product fingerprint unaltered and comparable to SEQ ID NO:190 (the "wild-type"), the 6X-2 variant (SEQ ID NO:380, encoded by SEQ ID NO:379) is particularly notable. To our knowledge the shift in $T_m$ obtained for these variants is the highest increase reported from the application of directed evolution technologies.

SEQ ID NO:380 (the 6X-2 variant) includes the following changes, as compared to SEQ ID NO:190 (the "wild-type"): D8F, Q11H, G17I, G60H, S65V and G68A. SEQ ID NO:379 includes the following nucleotide changes, as compared to the "wild type" SEQ ID NO:189: the nucleotides at positions 22 to 24 are TTC, the nucleotides at positions 31 to 33 are CAC, the nucleotides at positions 49 to 51 are ATA, the nucleotides at positions 178 to 180 are CAC, the nucleotides at positions 193 to 195 are GTG, the nucleotides at positions 202 to 204 are GCT.

In order to gauge the effectiveness of combinatorial mixing versus addition of the point mutants to the desired phenotype, a fitness parameter combining contributions both from changes in enzyme activity and thermostability was calculated for each mutant. The term fitness as described here is not an objective measure that can be compared to other enzymes, but rather a term that allows the measurement of the success of directed evolution of this particular xylanase. Since enzyme fitness, F, is calculated by equally weighting changes in $T_m$ and enzyme activity for this set of variants, the maximum allowable fitness value is 2 (Ft 1 and Fv 1, see above). In other words, if the variant with the best activity also had the highest $T_m$, its fitness value would be 2. With a fitness value near 2 (see FIG. 10B), the 6X-2 variant (SEQ ID NO:380, encoded by SEQ ID NO:379) is the closest to possessing the best possible combination of thermal stability and enzyme activity. The single site mutation that confers the highest value of fitness is S65V. Although the $T_m$ of the S65V mutant is lower than that of the Q11H mutant (66° C. verses 70° C. respectively), it has a higher fitness value since its specific activity is not reduced relative to wild-type.

Figure 10:
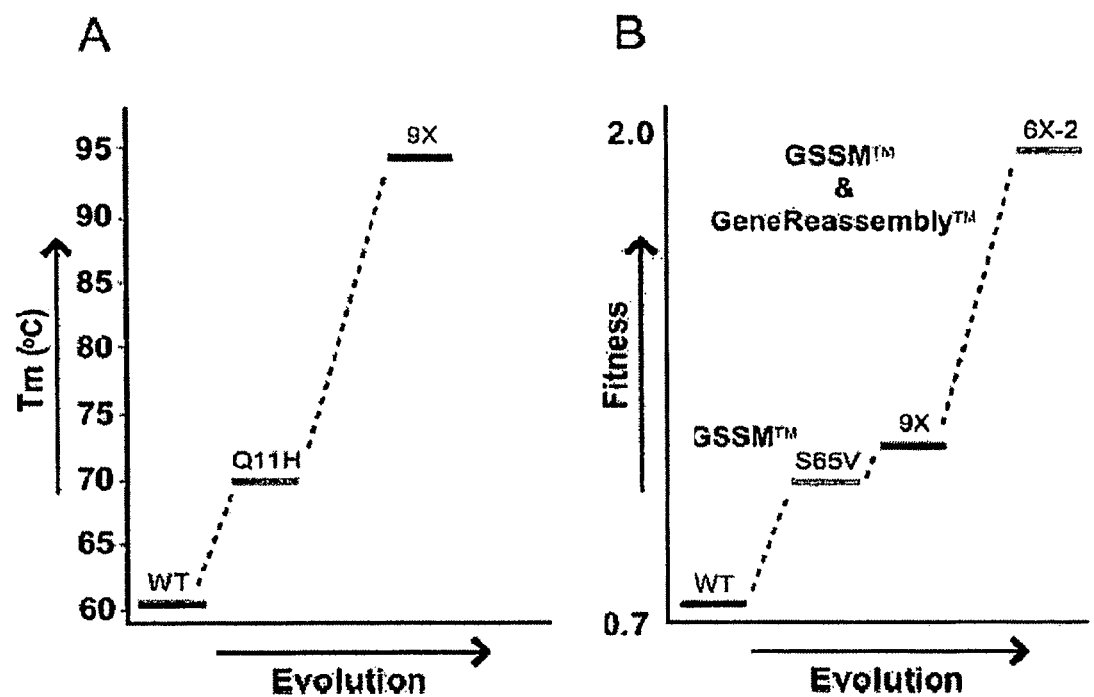
FIG. 10A is a schematic diagram illustrating the level of thermal stability (represented by Tm) improvement over SEQ ID NO:190 ("wild-type") obtained by GSSM evolution, as described in detail in Example 5, below.
FIG. 10B illustrates a "fitness diagram" of enzyme improvement in the form of SEQ ID NO:378 and SEQ ID NO:380, as obtained by combining GSSM and GeneReassembly technologies, as described in detail in Example 5, below.

FIG. 10A is a schematic diagram illustrating the level of thermal stability (represented by $T_m$) improvement over "wild-type" obtained by GSSM evolution. The single site amino acid mutant and the combinatorial variant with the highest thermal stability (Q11H and "9X" (SEQ ID NO:378), respectively) are shown in comparison to wild-type. FIG. 10B illustrates a "fitness diagram" of enzyme improvement obtained by combining GSSM and GeneReassembly technologies. Fitness was determined using the formula F=FT+FV where fitness (F) is calculated by equally weighting thermal tolerance fitness (FT) and relative activity fitness (FV) as described above. The point mutation that confers the greatest fitness (S65V) is shown. Combining all 9 point mutations also improved fitness (SEQ ID NO:378, the "9X" variant). However, the largest improvement in fitness was obtained by combining GSSM and GeneReassembly methods to obtain the best variant, 6X-2 (SEQ ID NO:380).

The GeneReassembly method also allowed the identification of important residues that appear absolutely necessary for improved thermal stability. Two key residues, Q11H and G17I, were present in every GeneReassembly variant identified based on thermal tolerance (see FIG. 6A). The structural determinants for thermal stability of proteins have been studied and several theories have been documented, e.g., by Kinjo (2001) Eur. Biophys. J. 30:378-384; Britton (1999) J. Mol. Biol. 293:1121-1132; Ladenstein (1998) Adv. Biochem. Eng. Biotechnol. 61:37-85; Britton (1995) Eur. J. Biochem. 229: 688-695; Tanner (1996) Biochemistry 35:2597-2609; Vetriani (1998) Proc. Natl. Acad. Sci. USA 95:2300-2305. Hydrogen bonding patterns, ionic interactions, hydrophobic packing and decreased length of surface loops are among the key factors even though the contribution of each to protein stability is not fully understood. Given that most of the beneficial point substitutions identified from testing all possible single amino acid substitutions involved the replacement of relatively polar, charged or small (glycine) residues for much larger hydrophobic residues, it can surmised that hydrophobic interactions play the most significant role in enhancing the imostability of this protein. Even with a good understanding of the optimal interactions to enhance thermal tolerance, the prediction of where to make mutations that introduce such interactions is not straightforward. A nonrational approach using the GSSM method, however, allows rapid sampling of all sidechains at all positions within a protein structure. Such an approach leads to the discovery of amino acid substitutions that introduce functional interactions that could not have been foreseen.

Example 6

Pre-Treating Paper Pulp with Xylanases of the Invention

In one aspect, xylanases of the invention are used to treat/pretreat paper pulp, or recycled paper or paper pulp, and the like. In one aspect, enzyme(s) of the invention are used to increase the "brightness" of the paper via their use in treating/pretreating paper pulp, or recycled paper or paper pulp, and the like.

In one aspect, xylanases of the invention are used to treat/pretreat paper pulp, or recycled paper or paper pulp, and the like to reduce the Kappa number. Kappa number is defined as a numerical value indicating a paper's relative lignin content—the higher the Kappa number, the higher the lignin content. We have observed in our mill trials a consistent 1-2 point reduction in Kappa # with xylanases of this invention, e.g., with SEQ ID NO:381/382 (i.e., using the enzyme having the sequence of SEQ ID NO:382, encoded, e.g., by SEQ ID NO:381) and SEQ ID NO:481/482 treatment. In some aspects, this reduction in Kappa # has benefits when treating unbleached pulp (kappa # 70-90), when then is used for, e.g., processing, such as in board manufacture. In some aspects, a reduction in Kappa across the X stage allows lower alkali use in cooking or cooking to a higher target Kappa #. In some aspects, this results in higher pulp strength, less machine refining and higher machine speeds. In some aspects, such results are seen using digester additives (surfactants) in linerboard mills; this can allow for better liquor penetration, and allow lower effective alkali charge leading to higher pulp strength, lower refining and a 200 fpm (feet per minute) increase in machine speed.

This example describes an exemplary routine screening protocol to determine whether a xylanase is useful in pretreating paper pulp; e.g., in reducing the use of bleaching chemicals (e.g., chlorine dioxide, $ClO_2$) when used to pretreat Kraft paper pulp.

The screening protocol has two alternative test parameters: Impact of xylanase treatment after an oxygen delignification step (post-$O_2$ pulp); and, impact of xylanase in a process that does not include oxygen delignification (pre-$O_2$ brownstock).

The invention provides pulp or paper treatment conditions that simulate process conditions in industrial situations, e.g., factories: for example, at about pH 8.0; 70° C.; 60 min duration. For example, an exemplary process of the invention is schematically depicted in the Flow Diagram of FIG. 11; see also FIG. 14. However, the conditions of a process of method of the invention can be adjusted to any temperature, time duration and/or pH, depending on the exemplary enzyme(s) of the invention used and the objective of the process; for example, there are a variety of ways to adjust pH in the various pulp and paper processes of the invention:

adding acid and/or base:
Hydrochloric acid (HCl)
Sodium hydroxide (NaOH)
$H_2SO_4$ (sulfuric acid)
$NaHSO_4$ (sodium hydrogen sulfate)
$H_2SO_3$ (sulfurous acid)
$H3PO_4$ (phosphoric acid)
HF (hydrofluoric acid)
$CH_3CO_2H$ (acetic acid)
$H_2CO_3$ (carbonic acid)
$H_2S$ (hydrogen sulfide)
$NaH_2PO_4$ (sodium dihydrogen phosphate)
$NH_4Cl$ (ammonium chloride)
HCN (hydrocyanic acid)
$Na_2SO_4$ (sodium sulfate)
NaCl (sodium chloride)
$NaCH_3CO_2$ (sodium acetate)
$NaHCO_3$ (sodium bicarbonate)
$Na_2HPO_4$ (sodium hydrogen phosphate)
$Na_2SO_3$ (sodium sulfite)
NaCN (sodium cyanide)
$NH_3$ (aqueous ammonia)
$Na_2CO_3$ (sodium carbonate)
$Na3PO_4$ (sodium phosphate)
bubbling in gas, e.g. $CO_2$ (which forms an acid with water when dissolved)

Twenty xylanases were identified by biochemical tests that were active under these conditions. Of the 20 xylanases, 6 were able to significantly reduce $ClO_2$ demand when they were used to pretreat Kraft pulp before it was chemically bleached. The six are: SEQ ID NO:182 (encoded by SEQ ID NO:181); SEQ ID NO:160 (encoded by SEQ ID NO:159); SEQ ID NO:198 (encoded by SEQ ID NO:197); SEQ ID NO:168 (encoded by SEQ ID NO:167); SEQ ID NO:216 (encoded by SEQ ID NO:215); SEQ ID NO:260 (encoded by SEQ ID NO:259). Others showed some activity but were not as good. Xylanases SEQ ID NO:182 (encoded by SEQ ID NO:181) and SEQ ID NO:160 (encoded by SEQ ID NO:159) are modular and contain a carbohydrate binding module in addition to the xylanase catalytic domain. It was demonstrated that truncated derivatives of these 2 xylanases containing just the catalytic domain are more effective in this application. The best xylanase, SEQ ID NO:160 (encoded by SEQ ID NO:159) was studied more comprehensively. Results can be summarized as follows:

pretreatment of post-$O_2$ spruce/pine/fir (SPF) pulp with 2 units/g of SEQ ID NO:160 (encoded by SEQ ID NO:159) reduces subsequent $ClO_2$ use by 22% to reach 65% GE brightness;

pretreatment of pre-$O_2$ brownstock SPF with 0.5 units/g SEQ ID NO:160 (encoded by SEQ ID NO:159) reduces subsequent $ClO_2$ use by 13% to reach 65% GE brightness;

pretreatment of pre-$O_2$ Aspen pulp with 0.5 units/g SEQ ID NO:160 (encoded by SEQ ID NO:159) reduces $ClO_2$ use by at least 22%;

pretreatment of pre-$O_2$ Douglas Fir/Hemlock pulp with 0.5 units/g SEQ ID NO:160 (encoded by SEQ ID NO:159) reduces $ClO_2$ use by at least 22%;

under the treatment conditions employed, the reduction in yield from the xylanase treatment did not exceed 0.5% when compared with pulp that had been bleached at the same kappa factor but not treated with xylanase;

optimal conditions for treating post-$O_2$ SPF pulp with SEQ ID NOS:159, 160 were: pH 6-7, enzyme dose 0.3 units/g, treatment time 20-25 min. Under these conditions, reduction in $ClO_2$ use of 28% was possible to reach 69% GE brightness.

In further experiments:

SEQ ID NO:160 (XYLA), encoded by SEQ ID NO:159=full length wild type xylanase:

XYLA (E.c)=truncated variant of SEQ ID NOS:159, 160 containing only xylanase catalytic domain expressed in *E. coli*

XYLA (P.f)=ditto but expressed in *P. fluorescens*

SEQ ID NO:182 (encoded by SEQ ID NO:181)=second full-length wild type xylanase:

XYLB (E.c)=truncated variant etc, etc expressed in *E. coli*

XYLB (P.f)=ditto but expressed in *P. fluorescens*

Dose Response Data for Lead Xylanases on Pre-O2 Brownstock

Conditions for Xylanase Stage (X-Stage) as Follows:
pH 8
Temperature 70° C.
Time 60 min
Kappa factor 0.24
For no-enzyme control, kappa factor was 0.30

Results showed a dose dependent increase in brightness for xylanase-treated samples at a lower charge of chlorine dioxide ($ClO_2$) (Kf 0.24 vs Kf 0.30).

In each case, the truncated derivative looked to be more effective that the full-length xylanase. Optimal xylanase dose looked to be around 0.6 to 0.7 U/g pulp.

Pretreatment of Intercontinental Pre-$O_2$ Brownstock with the Best 4 Xylanases

Determination of $ClO_2$ Dose Response in $D_o$
Experimental Outline
Pre-$O_2$ Brownstock
Initial kappa 31.5
X stage conditions
Xylanase charge 0.7 U/gm
Temperature 70° C.
pH8
Treatment time 1 hr
Pulp consistency 10%
Bleach sequence $XDE_p$
Kappa factor 0.22, 0.26 and 0.30 (% D on pulp: 2.63, 3.12 and 3.60)

Final Brightness after 3-Stage Bleach Sequence Versus Kappa Factor ($ClO_2$ Charge):

XYLB—At 61.5 final brightness, X-stage enables reduction in $ClO_2$ use of 3.89 kg/ton pulp.

XYLB (E.c)—At 61.5 final brightness, X-stage enables reduction in $ClO_2$ charge of 4.07 kg/ton pulp.

XYLA—At 61.5 brightness, X-stage enables a reduction in $ClO_2$ use of 4.07 kg/ton pulp.

XYLA (E.c)—At 61.5 final brightness, X-stage enables reduction in $ClO_2$ use of 4.90 kg/ton pulp.

| Enzyme | $ClO_2$ Savings in $D_o$ (kg/ton OD) | Kf reduction in $D_o$ |
|---|---|---|
| XYLB | 3.89 | 11.7% |
| XYLB (E.c) | 5.08 | 15.8% |
| XYLA | 4.07 | 12.2% |
| XYLA (E.c) | 4.90 | 14.7% |

Determination of $ClO_2$ Dose Response in $D_o$:
Xylanase 0.7 U/g, pH 8.0, 70° C., 1 hr
Pulp: Pre-$O_2$ Brownstock, initial kappa 31.5

Percentage saving of $ClO_2$ is of little significance to the industry. Their primary concern is lbs of $ClO_2$ required per ton OD pulp. This makes sense when one considers that a lower percentage saving seen with a high initial kappa brownstock can be more valuable in terms of lbs of $ClO_2$ saved than a higher percentage reduction for a low initial kappa pulp which will require a lower total charge of $ClO_2$ to reach target brightness.

Relationship Between Brightness, Yield and Kappa Factor for Bleached Control Pulp:

The results showed that bleaching with increasing doses of $ClO_2$ to achieve higher target brightness results in increased loss of pulp yield. This is an issue because pulp at this stage of the process has a value of almost $400 per ton and loss of cellulose costs money.

A benefit of xylanase (e.g., a xylanase of the invention) is that use of a lower $ClO_2$ dose can reduce yield losses as long as the action of the xylanase itself doesn't cancel out the gain.

Dose Response Data for Pretreatment of Pre-$O_2$ Brownstock with Xylanase XYLB (P.f):

Experimental Outline
Northwood Pre-$O_2$ Brownstock
Initial kappa 28.0
Initial consistency 32.46%
Initial brightness 28.37
X stage conditions
Xylanase charge 0 to 2.70 U/gm
Temperature 58° C. to 61° C.

pH 8.2 to 8.5
Treatment time 1 hr
Bleach sequence XDE$_p$
Kappa factor 0.24
ClO$_2$ saving calculated for Kappa factors between 0.24 and 0.30

The purpose of this experiment was to evaluate the best of the 4 xylanases on unwashed SPF brownstock. Results showed dose-dependent increases in final brightness for pulp treated with XYLB (E.c), with brightness achieved in presence of xylanase at lower Kf of 0.24, approaching brightness achieved at higher Kf of 0.30 asymptotically.

Relationship Between Dose of Xylanase XYLB (E.c) and Chlorine Dioxide Saving (Pre-O$_2$ Brownstock):
Optimum Xylanase Dose is between 0.5 and 0.9 U/gm The optimum dose lies in the range 0.5 to 0.9 U/g. Above this dose there is a diminishing return per unit increment of xylanase. Reductions in chlorine dioxide dose per ton of pulp treated of this magnitude are commercially significant.

| ClO$_2$ Saving in % OD Pulp | ClO$_2$ Saving in kg/ton Pulp | Xylanase Dose in U/gm |
|---|---|---|
| 0.299% | 2.99 | 0.31 |
| 0.363% | 3.63 | 0.51 |
| 0.406% | 4.06 | 0.71 |
| 0.439% | 4.39 | 0.91 |
| 0.483% | 4.83 | 1.26 |
| 0.523% | 5.32 | 1.80 |
| 0.587% | 5.87 | 2.70 |

Three-Stage Biobleaching Procedure

The invention provides a three-stage biobleaching procedure, and in one aspect, this process comprises at least one enzyme of this invention. This exemplary three-stage biobleaching procedure was developed to closely simulate the actual bleaching operations in a pulp mill bleach plant (see FIG. 11). This bleach sequence is designated by (X) DoEp, in which X represents the xylanase treatment stage, D for chlorine dioxide bleaching stage, and Ep for alkaline peroxide extraction stage. The primary feedstock used in our application tests was Southern Softwood Kraft Brownstock (without oxygen delignification).

The most effective xylanase candidates (enzymes of the invention) that showed high bleach chemical reduction potential in the biobleaching assays were also tested on two species of hardwood Kraft pulp (maple and aspen). Upon completion of each biobleaching round, the ensuing pulp was used to produce TAPPI (Technical Association of Pulp and Paper Industries, the technical association for the worldwide pulp, paper and converting industry)—standard handsheets. The GE % brightness of each handsheet was measured, and the brightness values were used as the indication of how well each enzyme had performed on the pulp during the enzymatic pretreatment stage (X).

Results:

Out of approximately 10 xylanases that were screened using the (X) DoEp biobleaching sequence, 4 enzymes, i.e., XYLA (P.f); XYLB (P.f); SEQ ID NO216 (encoded by SEQ ID NO:215); SEQ ID NO:176 (encoded by SEQ ID NO:175); showed the greatest potential for reducing the use of bleaching chemicals. While XYLA (P.f) and XYLB (P.f) exhibited equally high performance (best among the four good performers), XYLA (P.f) showed a better pH tolerance than XYLB (P.f). The results can be summarized as follows:

It is possible to achieve a handsheet brightness of 60 (GE %) using a three-stage bleach sequence [(X)DoEp] that involves pretreatment of Southern Softwood Kraft Brownstock with the following four enzymes at the loading levels listed below (pH=8, 65° C. & 1 h):
XYLA (P.f) at 0.55 U/g pulp
XYLB (P.f) at 0.75 U/g pulp
SEQ ID NOS:215, 216 at 1.80 U/g pulp
SEQ ID NOS:175, 176 at 1.98 U/g pulp Pretreatment of Southern Softwood Kraft Brownstock with 2 U/g pulp of XYLA (P.f) reduces ClO$_2$ use by 18.7% to reach a final GE % brightness of 61.

XYLA (P.f) exhibits good tolerance at higher pH and provides more than 14% chemical savings when the enzymatic pretreatment stage is run at pH=10.

Pretreatment of Southern Softwood Kraft Brownstock with 2 U/g pulp of XYLB (P.f) reduces ClO$_2$ use by 16.3% to reach a final GE % brightness of 60.5.

Pretreatment of aspen Kraft pulp with 2 U/g pulp of XYLA (P.f) and XYLB (P.f) reduces ClO$_2$ use by about 35% to reach a final GE % brightness of 77.

Pretreatment of maple Kraft pulp with 2 U/g pulp of XYLA (P.f) and XYLB (P.f) reduces ClO$_2$ use by about 38% to reach a final GE % brightness of 79.

The two best performing xylanases, namely XYLA (P.f) and XYLB (P.f), are truncated enzymes, containing just the catalytic domain, and were produced in *Pseudomonas fluorescens*.

Example 7

Exemplary Xylanases for Pulp and Paper Processes

The technical target for the evolved xylanase was to increase thermotolerance in the application (e.g., up to and including 90° C.) as well as broader pH profile (performance at pH 8-10). The polypeptide having a sequence as set forth in SEQ ID NO:384, encoded by, e.g., SEQ ID NO:383 ("SEQ ID NO:383/384") was evolved to match target specifications by creating and screening libraries of GSSM followed by gene reassembly of top single-mutant hits. The starting point for GSSM was SEQ ID NO:383/384, a three amino acid (3-aa) C-terminal truncation of SEQ ID NO:381/382. The screening was performed in an *E. coli* host, and the sequences of the parent gene (SEQ ID NO:383/384) are given below.

```
                                              (SEQ ID NO:383)
ATGGCTCAGACCTGCCTCACGTCGAGTCAAACCGGCACTAACAATGGCTT

CTATTATTCCTTCTGGAAGGACAGTCCGGGCACGGTGAATTTTTGCCTGC

AGTCCGGCGGCCGTTACACATCGAACTGGAGCGGCATCAACAACTGGGTG

GGCGGCAAGGGATGGCAGACCGGTTCACGCCGGAACATCACGTACTCGGG

CAGCTTCAATTCACCGGGCAACGGCTACCTGGCGCTTTACGGATGGACCA

CCAATCCACTCGTCGAGTACTACGTCGTCGATAGCTGGGGGAGCTGGCGT

CCGCCGGGTTCGGACGGAACGTTCCTGGGGACGGTCAACAGCGATGGCGG

AACGTATGACATCTATCGCGCGCAGCGGGTCAACGCGCCGTCCATCATCG

GCAACGCCACGTTCTATCAATACTGGAGCGTTCGGCAGTCGAAGCGGGTA

GGTGGGACGATCACCACCGGAAACCACTTCGACGCGTGGGCCAGCGTGGG

CCTGAACCTGGGCACTCACAACTACCAGATCATGGCGACCGAGGGCTACC
```

```
AAAGCAGCGGCAGCTCCGACATCACGGTGAGTTAA (SEQ ID NO:384)
MAQTCLTSSQTGTNNGFYYSFWKDSPGTVNFCLQSGGRYTSNWSGINNWV

GGKGWQTGSRRNITYSGSFNSPGNGYLALYGWYTTNPLVEYYVVDSWGSW

RPPGSDGTFLGTVNSDGGTYDIYRAQRVNAPSIIGNATFYQYWSVRQSKR

VGGTITTGNHFDAWASVGLNLGTHNYQIMATEGYQSSGSSDITVS
```

The GSSM library was subjected to thermal challenge of 74° C., and then screened for clones exhibiting highest activity on azo-xylan soluble substrate. The top candidates were re-confirmed on azo-xylan during secondary and tertiary screening. Top 15 single mutant clones were selected for gene reassembly. List of single mutants generated:

| AA Position | Mutation |
|---|---|
| 4 | T4L |
| 9 | S9P |
| 10 | Q10S |
| 13 | T13F |
| 13 | T13Y |
| 14 | N14H |
| 18 | Y18F |
| 25 | S25E |
| 30 | N30V |
| 34 | Q34C |
| 34 | Q34H |
| 34 | Q34L |
| 35 | S35E |
| 71 | S71T |
| 194 | S194H |

Thermotolerance properties of select single mutants are given in the table below:

Select Single GSSM Mutants Maximum Tolerated Temperature

| Clone | Maintains performance up to: (based on azo-xylan activity assay) |
|---|---|
| wt | 72° C. |
| S9P | 80° C. |
| T13F | 80° C. |
| N14H | 82.5° C. |
| Y18F | 80° C. |
| Q34C | 80° C. |

Reassembly screen was run on azo-xylan substrate in the same fashion as the screen of GSSM library. The stringency of screening was increased to 90° C. and 1 hour for the heat challenge step. The top recombed clones were characterized by their performance on application substrates in bag biobleaching protocols. Below is the list of clones selected for application testing, with amino acid changes relative to the parent SEQ ID NO:384.

| Clone | \multicolumn{11}{c}{AMINO ACID POSITION} | NOTES |

| Clone | 4 | 9 | 10 | 13 | 14 | 18 | 25 | 30 | 34 | 35 | 71 | 194 | NOTES |
|---|---|---|---|---|---|---|---|---|---|---|---|---|---|
| Parent (WT) | T | S | Q | T | N | Y | S | N | Q | S | S | S | Wild-type sequence Incorporated mutations listed, blank means wild type aa selected |
| Xyl1 |  | P |  | Y | H | F | E |  | C | E | T | H |  |
| Xyl2 |  | P |  | F | H | F |  |  | L | E | T |  |  |
| Xyl3 |  |  | S | F | H |  |  |  | C | E | T | H |  |
| Xyl4 |  |  |  | F | H |  | E |  | H | E |  | H |  |
| Xyl5 |  | P | S |  | H | F | E |  | H | E | T | H |  |
| Xyl6 |  | P | S | Y | H | F | E |  | L | E | T | H |  |
| Xyl7 |  | P |  | F | H | F | E |  | C | E | T |  |  |
| Xyl8 |  | P |  | F | H | F | E |  | C | E | T | H |  |
| Xyl9 |  | P | S | F | H |  | E | V | C | E | T | H |  |
| Xyl10 |  | P | S | Y | H |  | E | V | L | E | T | H |  |
| Xyl11 |  | P |  | Y | H |  | E | V | L | E |  | H |  |
| Xyl12 |  | P |  | Y | H |  | E | V | L | E | T | H |  |
| Xyl13 |  | P | S |  | H | F | E |  | C | E | T |  |  |
| Xyl14 |  | P | S |  | H | F | E | V | H | E | T |  |  |
| Xyl15 |  | P | S | F | H | F | E |  | C | E |  | H |  |
| Xyl16 |  | P | S | F | H | F | E |  | H | E | T | H |  |

-continued

| Clone | | | | | AMINO ACID POSITION | | | | | | | | NOTES |
|---|---|---|---|---|---|---|---|---|---|---|---|---|---|
| | 4 | 9 | 10 | 13 | 14 | 18 | 25 | 30 | 34 | 35 | 71 | 194 | |
| Xyl17 | | P | | Y | H | | | | L | E | T | H | |
| Xyl18 | | P | S | Y | H | F | E | | | H | E | T | H |
| Xyl19 | | P | S | | H | F | E | V | L | E | T | | |
| Xyl20 | | P | | Y | H | | | | C | E | T | H | |
| Xyl21 | | P | | Y | H | | E | | | H | E | T | |
| Xyl22 | | | | Y | | F | | | | | T | | Triplet |
| Xyl23 | | P | | | H | F | | | C | E | | | Pentuplet |
| Xyl24 | L | | | | H | | E | | C | E | | | Pentuplet |

Based on the results of applications testing, two clones were selected. Those are Xyl2 and Xyl4. Their specific activities in U/mg have been determined using the arabinoxylan reducing sugar assay (the so-called "Nelson-Somogyi assay", as discussed, above). These data are listed below.

| Clone | Calibrated U/mL | Protein concentration | Calibrated U/mg |
|---|---|---|---|
| SEQ ID NO: 382 | 172.6 | 1.62 | 106:4 |
| SEQ ID NO: 384 | 1032.4 | 9.85 | 104.9 |
| Xyl2 | 723.8 | 5.94 | 121.9 |
| Xyl4 | 2217.8 | 17.73 | 125.1 |

Results of Differential Scanning Calorimetry for Select Single Point Mutants and Reassembled Top Hits:
Xylanase Top Candidates DSC Measurements vs. Parent Xylanases
Transition Temperature at which Enzyme is Irreversibly Inactivated (Unfolded)

| | Melting Temp |
|---|---|
| SEQ ID NO: 382 | 80.9° C. |
| SEQ ID NO: 384 | 86.6° C. |
| Xyl2 | 103.5° C. |
| Xyl4 | 102.2° C. |

In one aspect, the single mutations noted above were combined to generate an enzyme having at least two, several or all of the point mutations noted above; see, e.g., Table 10, below. Thus, the invention provides polypeptides having xylanase activity having one, at least two, several or all of the point mutations noted above, and nucleic acids encoding them.

Example 8

Novel Biobleaching Assay for Assessing Xylanase Performance in Enhancing the Brightness of Pulp This example describes an exemplary protocol, a "biobleaching assay," that can be used to determine if a polypeptide has xylanase activity and is within the scope of the invention. This assay was used to assess the performance of an exemplary enzyme of the invention having a sequence as set forth in SEQ ID NO:384 (encoded, e.g., by SEQ ID NO:383) in enhancing the brightness of Kraft Pulp. This and any other xylanase enzyme of the invention can be used to enhance the brightness of a pulp, e.g., a Kraft Pulp.

Figure 11:
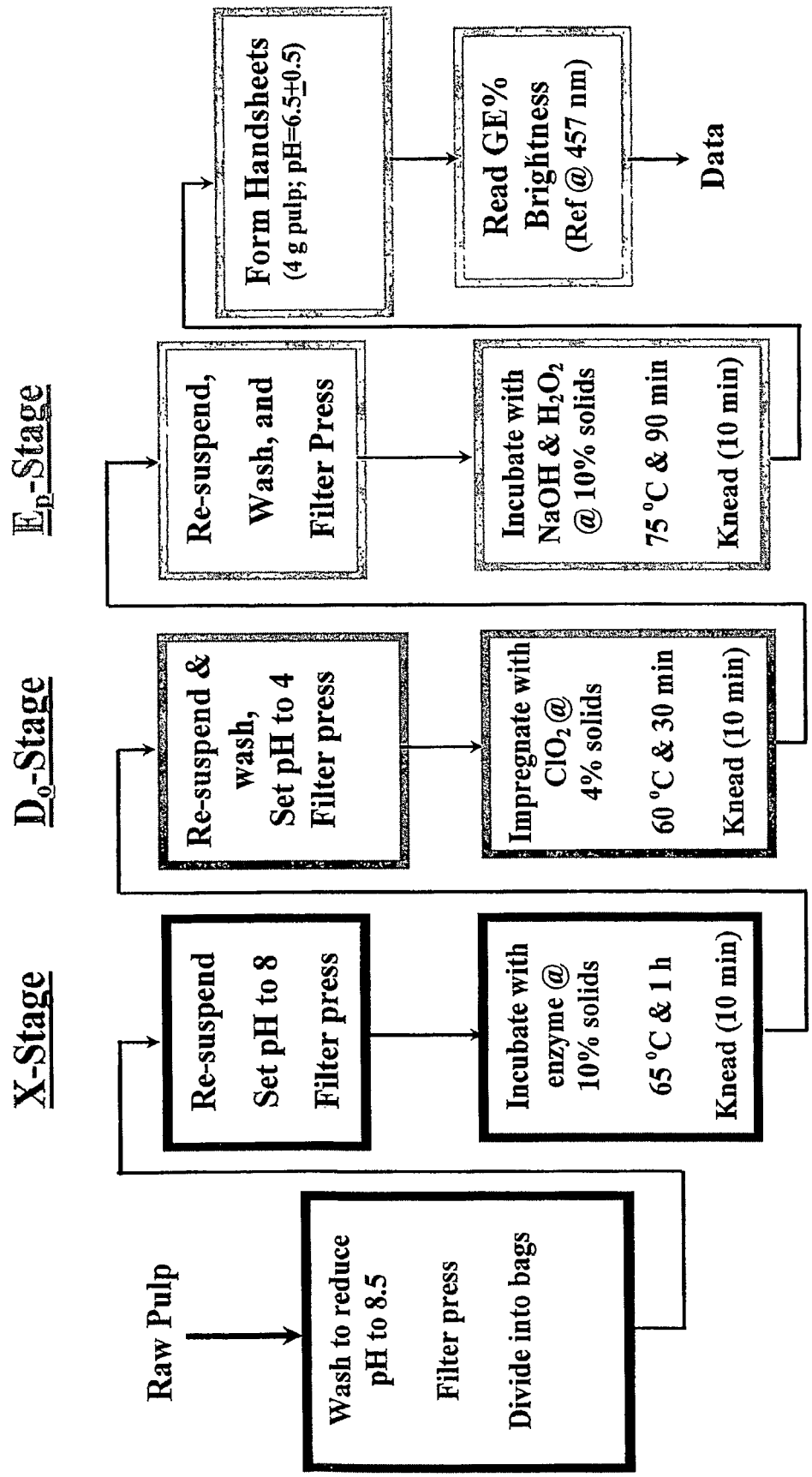
FIG. 11 is a schematic flow diagram of an exemplary routine screening protocol to determine whether a xylanase of the invention is useful in pretreating paper pulp, as described in detail in Example 6, below.
Figure 14:
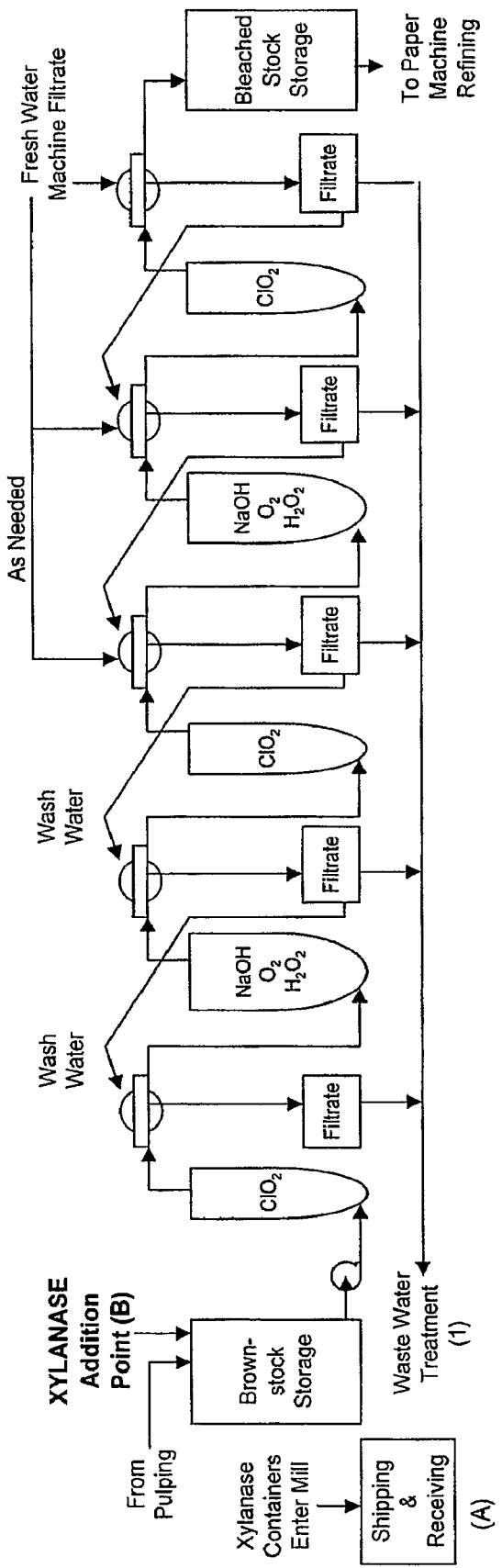
FIG. 14 illustrates a biobleaching industrial process of the invention, as described in detail in Example 9, below.

The invention provides biobleaching procedures, e.g., a three-stage biobleaching procedure that closely simulates the conditions of an actual pulp mill bleach plant, as illustrated in FIG. 11; including a process as illustrated in FIG. 14. This bleach sequence is designated by (X) DoEp, in which X represents the xylanase treatment stage (using, e.g., an enzyme of the invention), D for chlorine dioxide bleaching stage, and Ep for alkaline peroxide extraction stage. The feedstock used in our application tests was Southern Softwood Kraft Brownstock (without oxygen delignification). Upon completion of each biobleaching round, the ensuing pulp was used to produce TAPPI (Technical Association of Pulp and Paper Industries)—standard handsheets. The GE % brightness of each handsheet was measured, and the brightness values were used as the indication of how well the enzyme had performed on the pulp during the enzymatic pretreatment stage (X).

Pulp biobleaching: Pulp was bleached in 10-g batches in sealed plastic bags using a 3-stage (X) DoEp sequence, as illustrated in FIG. 11. The treatment conditions at the three stages can be summarized as follows:
  X stage: 10% (w/v) consistency at 65° C. and pH=8 for 60 min+
  Do stage: 4% (w/v) consistency at 60° C. for 30 min; Kappa Factor=0.18 for enzyme treated samples, and 0.18 and 0.21 for no-enzyme controls.
  Ep stage: 10% (w/v) consistency at 75° C. for 90 min; caustic charge: 1.7% (w NaOH/w OD pulp) and $H_2O_2$ charge: 0.5% (w/w)

As noted in FIG. 11, raw pulp was washed to reduce pH to pH 8.5; pulp was filter pressed and divided into bags. At each stage, bags were incubated in a water bath at the desired temperature and each bag was taken out and kneaded thoroughly every 10 min to ensure uniform mass and heat transfer within the pulp mass. After each treatment, pulp was filtered, washed with 2 L of DI water and filtered again before receiving the next treatment. The moisture content of the pulp was measured using a Mettler-Toledo moisture analyzer (Fisher Scientific, USA).

As noted in FIG. 11, after the pulp was filter pressed and divided into bags, in the X stage, the pulp was resuspended, filter pressed, the pH adjusted; and then, incubated with enzyme at 10% solids, 65° C., 1 hour; then kneaded for 10 minutes. At the Do stage the pulp was resuspended, washed, pH set to 4.0, and filter pressed; then, impregnated with $ClO_2$ at 4% solids (i.e., 4% (w/v) consistency) at 60° C. for 30 min; then kneaded for 10 minutes. At the Do stage the Kappa Factor=0.18 for enzyme treated samples, and 0.18 and 0.21 for no-enzyme controls. At theEp stage the pulp was resuspended, washed, and filter pressed; then, incubated with NaOH and $H_2O_2$ at 10% solids (i.e., 10% (w/v) consistency) at 75° C. for 90 min; then kneaded for 10 minutes. The caustic charge: 1.7% (w NaOH/w OD pulp) and $H_2O_2$ charge: 0.5% (w/w). After kneading, handsheets were formed.

Handsheets: As noted in FIG. 11, handsheets were formed (4 m pulp, pH about 6.5); handsheets were made from unbleached and bleached pulp using TAPPI standard equipment (Kalamazoo Paper Chemicals, Richland, Mich.) according to TAPPI method T-272 sp-97. The GE % brightness of each handsheet was measured using a BRIGHTMETER MICRO S-5/BC™ (Technidyne Corp., New Albany, Ind.) according to TAPPI method T-452 om-98 (reference at 457 nm).

Example 9

Novel Biobleaching Process

This example describes a novel biobleaching process of the invention, as illustrated in FIG. 14. This process can be practiced using any xylanase enzyme, including a polypeptide of the invention, including any exemplary enzyme of the invention, e.g., any polypeptide having the sequence of SEQ ID NO:2 to SEQ ID NO:636.

This exemplary process of the invention can have a starting material comprising "brownstock," which can be described as 1) feedstock preparation—logs coming into the paper mill are debarked, chipped and screened to remove overthick chips, fines, knots and foreign matter, 2) pulping—wood chips are cooked at 160° C. to 190° C. under pressure for several hours in a concentrated liquor of sodium hydroxide and sodium sulfide to separate cellulose fibers and increase cellulose content by extracting the majority of unwanted lignin. The output of this step is referred to as "brownstock", This process of the invention comprises a "Bleaching Step"—a multistage process by which residual lignin and other chromophores are removed to whiten the pulp to target brightness in preparation for making paper or other products. Pulp is treated with oxidizing chemicals, for example chlorine and chlorine dioxide, that attack lignin preferentially. In one aspect the process comprises a bleaching sequence where pulp is reacted with chlorine dioxide, the "$D_0$" stage (see also FIG. 13, and Example 8, the "$D_0$" stage); extracted with alkali in the presence of hydrogen peroxide, the "Ep" stage (see also FIG. 13, the "Ep" stage); reacted with chlorine dioxide a second time, a "D1" stage; extracted with alkali and hydrogen peroxide, an Ep stage; and, reacted with chlorine dioxide a third time, a D2 stage. In practicing this process, bleaching can be subject to many variations with respect to type and quantity of oxidizing chemicals used and the number of process steps (however, chlorine dioxide is currently the most widely used chemical oxidant). In one aspect, this process comprises pretreatment of cooked pulp with oxygen under pressure; the oxygen reactor can be at high pressure—at about 200 to 230° F. and pH 12 to 14 (this is a common first step in bleaching, known as "oxygen delignification").

In one aspect, this process comprises refining. For example, prior to papermaking bleached pulp is mechanically fined to collapse the cellulose fibers into flat ribbons, fibrilate their surfaces and improve their physical characteristics for papermaking. At any stage of the process following pulping, the pulp may be dewatered, washed and adjusted to a predetermined consistency by the addition of clean water or recycled streams.

Xylanase (e.g., an enzyme of the invention) can be just added after pulping, in the oxygen reactor or in the storage container just before the oxygen reactor. Xylanase (e.g., an enzyme of the invention) can be added at multiple points (one or more or all points) in the bleaching process. In one aspect, a laccase is added to catalyze break-down of lignin. The laccase may be added at any stage of the process, including in the oxygen reactor. Pulp may release various components that self-mediate the laccase. Alternatively, in one aspect, organic or inorganic mediators can be added (see, e.g., DE 19723890 describing an oxidation system comprising an organic mediator and a laccase; alternative exemplary mediators include 2,2'-azinobis(3-ethylbenzth-iazoline-5-sulphonate) (ABTS) as an exemplary organic mediator and potassium octacyanomolybdate $[K_4Mo(CN)_8]$ as an exemplary inorganic mediator). Mediators as described in U.S. patent application no. 20030096394, can also be used in the processes of the invention, including any compound capable of enhancing the activities of laccase and laccase-related enzymes.

In one aspect, an esterase, e.g. lipase, or oxidoreductase, e.g. peroxidase is added. In addition, pH and/or temperature can be modified in the reactor. In monitoring reactions of the invention, any lignin content-measuring technique can be used, e.g., see U.S. Patent Application No. 20020144795, describing a method to measure kappa number or lignin content of kraft pulps based on the voltammetric measurement of catalytic reactions involving lignin and redox mediators.

Enzymes of the invention can also be used in with alkali-oxygen bleaching (oxygen delignification) processes as described, e.g., in U.S. Pat. No. 6,824,646, the process comprising bleaching lignocellulose pulp in aqueous alkali solution with oxygen and treating the pulp with a hemicellulase, while a liquid fraction delivered from the enzyme treatment step is separated from the hemicellulase treated reaction mixture, and subjected to a penetration treatment through a separation membrane, for example, reverse osmosis membrane, to separate a permeated fraction from a non-permeated fraction; and then the permeated fraction is fed to the alkali-oxygen bleaching (oxygen delignification) step comprising use of an enzyme of the invention.

In alternative aspects of this or any other process (method) of the invention xylanases (e.g., enzymes of the invention) are used to reduce bleaching chemicals, e.g., chlorine, chlorine dioxide, caustic, peroxide, or any combination thereof; and in alternative aspects, a reduction of up to about 1%, 5%, 10%, 20%, 25%, 30%, 35%, 40%, 45%, 50%, 55%, 60%, 65%, 70%, 75%, 80%, 85%, 90%, 95% or more, or 100%, of chemicals can be seen in practicing the methods and using the enzymes of the invention. In one aspect, a 100% reduction in chemicals can be achieved when the xylanase is used in combination with a laccase or other enzyme, e.g., by use of enzyme cocktails; noting the invention provides enzyme mixtures, or "cocktails" comprising at least one enzyme of the invention and one or more other enzyme(s), which can be another xylanase, or any other enzyme.

In one aspect xylanases of the invention are used to reduce chlorine dioxide to allow recycling of water in the process; thus, there is less water used and less water dumped into the sewer. In one aspect xylanases of the invention are used to allow more lignin-rich pulp to enter the bleaching plant, allowing for better pulp yield and better quality pulp (i.e., less destruction during the cooking process). In one aspect, xylanases of the invention are used to increase the overall brightness of the paper. In one aspect, xylanases of the invention are used to lower the kappa number of the pulp.

Xylanases of the invention can be used, and the processes of the invention can be practiced, on all wood types, including, for example, on hard wood with, e.g., oxygen delignification, hard wood without oxygen delignification, soft wood with oxygen delignification and soft wood without oxygen delignification, and the like. Xylanases of the invention can be used, and the processes of the invention can be practiced for processing of recycled paper and/or pulp.

Oxygen delignification typically requires the addition of a reaction tower between a brownstock washer and a bleach plant. Typically, oxygen and sodium hydroxide are added to brownstock. Reduction of bleaching chemistry by 50% can be achieved in the bleaching process if preceded by oxygen delignification. Washing follows oxygen delignification; effluent can be recovered or discharged. Ozone delignification can be used in place of oxygen delignification.

Example 10

Novel Biobleaching Assay

This example describes data demonstrating xylanase activity in exemplary polypeptides of the invention. These xylanase activity studies were based on those described by Nelson (1944) J. Biol. Chem. 153:375-380, "Reducing Sugar Assay for Xylanase"; and, Somogyi (1952) J. Biol. Chem. 195:19-23. This "Nelson-Somogyi" assay is used to determine units of activity; data from "Nelson-Somogyi" assays demonstrating xylanase activity in exemplary polypeptides of the invention by determining units of activity is set forth, below.

Enzyme unit determinations also were determined using the Nelson-Somogyi assay. Biobleaching assays were based on methods from TAPPI ((Technical Association of Pulp and Paper Industries, see above). Below a description along with references to the TAPPI protocols.

Pulp: Two batches of southern softwood Kraft brownstock were obtained from the Department of Wood and Fiber Science at North Carolina State University (Raleigh, N.C.). The pulp Kappa Numbers were determined to be 21.4 or 29.7 respectively using TAPPI method T-236 om-99 {TAPPI Test Methods (2000-2001), 2003 173/id}.

Pulp biobleaching: Pulp was pretreated with xylanase and bleached in 10 g batches in sealed plastic bags using a 3-stage xylanase/chlorine dioxide/alkaline peroxide sequence: (X) DoEp (see explanation above). The treatment conditions at the three stages were as follows:

X stage: 10% (w/v) consistency at 65° C. and pH 8 for 60 min.

Do stage: 4% (w/v) consistency at 60° C. for 30 min; a Kappa Factor of 0.18 was used for enzyme treated samples, and 0.18 and 0.21 for no-enzyme control samples. The concentration of chlorine dioxide used during the Do stage was calculated using equation (1):

$$ClO_2\ \% = \frac{KF \times K\#}{2.63} \qquad (1)$$

Where $ClO_2\%$ was equal to g pure chlorine dioxide per 100 g oven-dried (OD) pulp KF was the Kappa Factor and K# was the Kappa Number of the pulp as determined by TAPPI method T-236 om-99{TAPPI Test Methods (2000-2001), 2003 173/id} Ep stage: 10% (w/v) consistency at 75° C. for 90 min; caustic charge was 17% on pulp (w/w) and $H_2O_2$ charge was 0.5% on pulp (w/w).

At each stage, replicate bags were incubated in a water bath at the desired temperature and were removed and kneaded thoroughly every 10 min to ensure uniform mass and heat transfer within the pulp mass. After each stage, pulp was filtered through a Buchner funnel lined with a hard polypropylene filter (297-micron mesh, Spectrum Labs, Ft. Lauderdale, Fla.). The filtrate was recycled once to catch the fines, and the pulp cake was washed with 2 L of DI water. The pulp cake was then re-suspended in 1.5 L of DI water and pH was adjusted to pH 8 and pH 4 prior to X and Do stages, respectively. The moisture content of the pulp was measured using a Mettler-Toledo moisture analyzer (Fisher Scientific, USA).

Handsheets were made from the bleached pulp using TAPPI standard equipment (Kalamazoo Paper Chemicals, Richland, Mich.) according to TAPPI method T-272 sp-97 {TAPPI Test Methods (2000-2001), 2003 173/id}. The GE % brightness of each handsheet was measured using a Technidyne Brightimeter™ Micro S-5/BC (Technidyne Corp., New Albany, Ind.) according to TAPPI method T-452 om-98.

| COMPONENTS used in assay (1) | |
|---|---|
| 1M NaOH | Solution 1: 12 g $K^+/Na^+$ tartrate; 24 g $Na_2CO_3$; 16 g $NaHCO_3$; 144 g $Na_2SO_4$ in 800 mL $H_2O$ |
| 0.5 M Sodium phosphate buffer pH 8 | |
| 1% Arabinoxylan - (Megazyme #P-WAXYM) prepared according to the manufacturer's instructions | Solution 2: 4 g $CuSO_4*5H_2O$; 36 g $Na_2SO_4$ in 200 mL $H_2O$ |
| Xylose - prepare standards 0.15 mM-2 mM using D-xylose dissolved in $H_2O$ | Reagent A: Mix 4 volumes of solution 1 with 1 volume of solution 2. Note-make fresh daily |
| 96 well PCR plate (Fisher 05 500-48) | |
| PCR plate seals | Reagent B: 25 g $(NH4)_2MoO_4$ in 450 mL $H_2O$; add 21 mL conc. $H_2SO_4$, mix. |
| Standard 96 well clear plates | |
| 1 mL tubes (E&K 671511-RC) for the 96 well block | Dissolve 3 g $Na_2HAsO_4*7H_2O$ in 25 mL $dH_2O$; mix with ammonium molybdate solution and incubate reagent at 37° C. for 24-48 h. Store solution in a dark bottle i.e. away from light at room temperature. |

Procedure
1. Prepare reagent A
2. Pipet 5 uL of 1 M NaOH into each well of a 96 well PCR plate. Keep plate on ice.
3. Prepare reaction mixture. Alternatively, you can make a master mix for multiple samples. Here is the 1× mix. Add to the 1 mL tubes and place into the 96 well block.
   a. 50 uL pHS Na-phosphate buffer
   b. 250 uL of 1% substrate (to make a final concentration of 0.5%)
   c. 150 uL $H_2O$
4. Preheat reaction mixture to desired temperature for 3 minutes.
5. Dilute the 0.5 M phosphate buffer to 5 mM pH 8 and make enzyme dilutions using this buffer.
6. Pipet 75 uL of diluted enzyme into a well of a 96 well microtiter plate
7. Pipet 50 uL of diluted enzyme into the 1 mL tube containing the reaction mix.
8. At the desired timepoint, pipet 50 uL from each reaction mixture into tubes containing the NaOH (the NaOH will raise the pH to 12, quenching the reaction).
9. Add 50 uL of each standard to separate tubes also containing NaOH. Standards are linear within the range of 0.25 mM xylose to 2.0 mM. Use at least 4 standards to generate the standard curve.
10. Add 50 uL of Reagent A to each well. Seal plate using the Microseal™ 'A' Film.
11. Heat the plate for 20 min. at 100° C. in a PCR machine. Set the machine to cool down to 4° C. after heating the samples.
12. Add 50 uL of reagent B to each tube, mix.
13. note a significant amount of $CO_2$ is formed after addition of reagent B. Care should be taken so sample does not contaminate adjacent wells.
14. Pipet 100 uL of each sample or standard into separate wells of a 96 well microtiter plate.
15. Read plate at 560 mm.
16. Plot standard curve data and express standards as umoles of xylose i.e. 50 uL of 2.5 mM xylose is 0.125 μmoles of xylose.
17. Subtract buffer control from sample data for each timepoint and plot the data
18. Divide timepoint curve slope value by the xylose standard curve slope value
19. Multiply by 10 (accounts for the 50 uL samples (1/10 of the total assay volume)
20. Divide by the volume used in the assay (0.05) to get μmoles of xylose released per min per mL of enzyme or U/mL of enzyme.
21. Divide this number by the protein concentration to get U/mg.

Data from "Nelson-Somogyi" assays demonstrating xylanase activity in exemplary polypeptides of the invention are set forth in Table 8, below. As noted above, assay conditions comprised pH 8; 65° C. U/mL, or, ph 8; 40° C. (U/mL).

In Table 8, to aid in reading Table 8, "SEQ ID NO:151, 152" means "the polypeptide having a sequence as set forth in SEQ ID NO:152, encoded, e.g., by a nucleic acid having a sequence as set forth in SEQ ID NO:151", etc.:

TABLE 8

| SEQ ID NO: | pH 8; 65 C. U/mL | ph 8; 40 C. (U/mL) |
|---|---|---|
| 151, 152 | low | 17.3 |
| 155, 156 |  | 13.5 |
| 169, 170 | ND | 1.62 |
| 195, 196 | 6.3 | 6.47 |
| 23, 24 | ND | 1 |
| 215, 216 | 34.7 | 55.9 |
| 5, 6 | ND | 6.3 |
| 121, 122 | ND | 139.4 |
| 405, 406 | ND | 41.34 |
| 47, 48 | ND | 31.2 |
| 191, 192 | 23 | 5 |
| 353, 354 | ND | 7 |
| 247, 248 | 5 | 146.3 |
| 307, 308 | 2.2 | 18 |
| 175, 176 | 37.7 | 36.2 |
| 7, 8 | ND | 16.1 |
| 161, 162 | 65 | 39.5 |
| 33, 34 | No apparent activity at conditions tested | 18.9 |
| 221, 222 | 2.2 | 2 |
| 225, 226 | ND | 9.5 |
| 27, 28 | ND | 10.1 |
| 163, 164 | 1186.44273 | 670.1 |
| 19, 20 | ND | 12.2 |
| 81, 82 | ND | 434 |
| 91, 92 | 88 | 194 |
| 61, 62 | ND | 0.9 |
| 469, 470 |  | 0.19 |
| 159, 160 | 224 |  |
| 299, 300 | 1.3 | 1 |
| 349, 350 | 577 | 128 |
| 233, 234 |  | 2.1 |
| 171, 172 | 0.55 | 0 |
| 203, 204 | 11.5 | 15.4 |
| 181, 182 | 282 |  |
| 227, 228 |  | 5.4 |
| 165, 166 | 4 | 3.34 |
| 335, 336 | 63 |  |
| 339, 340 | 60 | 1.9 |
| 141, 142 | ND | 544.63 |
| 231, 232 |  | 8 |
| 367, 368 | ND | 3 |
| 333, 334 | 4.1 | 10.18 |
| 281, 282 |  | 3.7 |
| 361, 362 | 5.4 | ND |
| 261, 262 | 32 | 49.5 |
| 319, 320 | 24.9 | 0 |
| 357, 358 | low | 65.5 |
| 365, 366 | 190 | 51 |
| 273, 274 |  | 16.65 |
| 277, 278 | 450 | 74.4 |
| 455, 456 | 850 | 423.02 |
| 129, 130 | 2.1 |  |
| 271, 272 | ND | 3 |
| 285, 286 | 25 | 11 |
| 259, 260 | 235 | 240.8 |
| 325, 326 | 1.5 | 7.4 |
| 359, 360 | 13 | 5.2 |
| 303, 304 | ND | 13.4 |
| 363, 364 |  | 2.1 |
| 93, 94 | ND | 24 |
| 157, 158 | ND | 2.6 |
| 189, 190 | 0.8 | ND |
| 25, 26 | low | 13.2 |
| 323, 324 | 260 | 51 |
| 49, 50 | ND | 0.05 |
| 85, 86 | 8 | 3.4 |
| 29, 30 | 3 |  |
| 51, 52 | 0.2 | ND |
| 35, 36 | 11.2 | 6.53 |
| 287, 288 |  | 1.45 |
| 293, 294 | 1042 | 219.23 |
| 99, 100 | 11.1 | 5.7 |
| 351, 352 | ND | 2 |
| 119, 120 | 3.4 | 19.36 |
| 123, 124 | 169 | 18.2 |
| 249, 250 | 2 |  |
| 311, 312 | 467 | 78.9 |
| 149, 150 | 9 |  |
| 167, 168 | 1500 | 46.8 |

TABLE 8-continued

| SEQ ID NO: | pH 8; 65 C. U/mL | ph 8; 40 C. (U/mL) |
|---|---|---|
| 207, 208 | 83 | 44.81 |
| 213, 214 | ND | 0.06 |
| 177, 178 | 12.1 | 7.6 |
| 113, 114 | 158 | 22.6 |
| 289, 290 | ND | 16.65 |
| 75, 76 | | 1 |
| 111, 112 | ND | 4.8 |
| 117, 118 | ND | 134.4 |
| 115, 116 | 36 | 15.9 |
| 125, 126 | ND | 31.5 |
| 137, 138 | ND | 2 |
| 451, 452 | 235 | 23.8 |
| 69, 70 | 44 | 2.1 |
| 205, 206 | low | 75 |
| 211, 212 | low | 159 |
| 197, 198 | 40 | 16.5 |
| 373, 374 | ND | 17.91 |
| 89, 90 | 12 | |
| 31, 32 | ND | 11.4 |
| 13, 14 | ND | 20.7 |
| 65, 66 | | 3.5 |
| 257, 258 | ND | 0.28 |
| 57, 58 | ND | 9.13 |
| 185, 186 | 49.9 | 119.3 |
| 77, 78 | 81 | |
| 73, 74 | ND | 3.5 |
| 243, 244 | | 8.6 |
| 229, 230 | 27 | 24.4 |
| 223, 224 | 1.5 | 2 |
| 109, 110 | 98 | 25.7 |
| 291, 292 | 17.65 | 3.8 |
| 179, 180 | ND | 5.7 |
| 3, 4 | | 77.1 |
| 193, 194 | 24 | 8.5 |
| 173, 174 | low | 15 |
| 217, 218 | 2.7 | 0.17 |
| 59, 60 | ND | 34.5 |
| 71, 72 | ND | 6.6 |
| 101, 102 | ND | 9 |
| 39, 40 | 99 | 61 |
| 269, 270 | ND | 3.2 |
| 139, 140 | | 13.2 |
| 55, 56 | 133 | 81.2 |
| 15, 16 | ND | 242.4 |
| 131, 132 | ND | 11.6 |
| 95, 96 | 146 | 136.3 |
| 143, 144 | 13 | 0.94 |
| 17, 18 | 7.2 | 2.6 |
| 21, 22 | ND | 8.1 |
| 153, 154 | 1.7 | 2 |
| 127, 128 | | 0.46 |
| 253, 254 | 12.6 | 28.3 |
| 255, 256 | | 13.15 |

"Units of Activity" data from the "Nelson-Somogyi" assays was used to determine dosing in biobleaching assays (based on TAPPI methods), as summarized in Table 9, below (to aid in reading Table 9, "SEQ ID NO:151, 152" means "the polypeptide having a sequence as set forth in SEQ ID NO:152, encoded, e.g., by a nucleic acid having a sequence as set forth in SEQ ID NO:151", etc.):

TABLE 9

| SEQ ID NO: | temp | pH | Units xylanase added | pulp type | outcome |
|---|---|---|---|---|---|
| 151, 152 | 40 | 8 | 2 | SSW | + |
| 169, 170 | 40 | 8 | 2 | New SPB | -- |
| 195, 196 | 40 | 8 | 2 | New SPB | -- |
| 121, 122 | 40 | 8 | 2 | New SPB | + |
| 191, 192 | 40 | 8 | 2 | New SPB | -- |
| 247, 248 | 65 | 8 | 2 | SSW | + |
| 161, 162 | 40 | 8 | 2 | New SPB | + |
| 225, 226 | 40 | 8 | 2 | New SPB | -- |
| 27, 28 | 40 | 8 | 2 | New SPB | -- |
| 81, 82 | 40 | 8 | 2 | New SPB | -- |
| 91, 92 | 40 | 8 | 2 | New SPB | -- |
| 61, 62 | 40 | 8 | 2 | New SPB | -- |
| 233, 234 | 40 | 8 | 2 | New SPB | -- |
| 171, 172 | 40 | 8 | 2 | New SPB | -- |
| 141, 142 | 40 | 8 | 2 | New SPB | -- |
| 231, 232 | 40 | 8 | 2 | New SPB | + |
| 367, 368 | 40 | 8 | 2 | New SPB | + |
| 261, 262 | 40 | 8 | 2 | New SPB | -- |
| 357, 358 | 40 | 8 | 2 | New SPB | -- |
| 365, 366 | 40 | 8 | 2 | New SPB | -- |
| 273, 274 | 40 | 8 | 2 | New SPB | - |
| 277, 278 | 65 | 8 | 2 | New SPB | - |
| 271, 272 | 40 | 8 | 2 | New SPB | + |
| 285, 286 | 65 | 8 | 2 | SSW | - |
| 325, 326 | 40 | 8 | 2 | New SPB | -- |
| 93, 94 | 40 | 8 | 2 | New SPB | - |
| 157, 158 | 40 | 8 | 2 | New SPB | - |
| 25, 26 | 65 | 8 | 2 | New SPB | -- |
| 85, 86 | 40 | 8 | 2 | New SPB | -- |
| 167, 168 | 65 | 8 | 2 | New SPB | + |
| 9, 10 | 40 | 8 | 2 | SSW | - |
| 43, 44 | 40 | 8 | 2 | New SPB | - |
| 75, 76 | 40 | 8 | 2 | New SPB | -- |
| 111, 112 | 40 | 8 | 2 | New SPB | -- |
| 117, 118 | 40 | 8 | 2 | New SPB | -- |
| 115, 116 | 40 | 8 | 2 | New SPB | -- |
| 125, 126 | 40 | 8 | 2 | New SPB | -- |
| 69, 70 | 40 | 8 | 2 | New SPB | -- |
| 205, 206 | 40 | 8 | 2 | New SPB | -- |
| 211, 212 | 40 | 8 | 2 | New SPB | - |
| 197, 198 | 65 | 8 | 2 | SSW | + |
| 31, 32 | 40 | 8 | 2 | New SPB | - |
| 13, 14 | 40 | 8 | 2 | New SPB | -- |
| 65, 66 | 40 | 8 | 2 | New SPB | -- |
| 57, 58 | 40 | 8 | 2 | New SPB | -- |
| 73, 74 | 40 | 8 | 2 | SSW | -- |
| 229, 230 | 40 | 8 | 2 | SSW | + |
| 179, 180 | 40 | 8 | 2 | New SPB | + |
| 3, 4 | 40 | 8 | 2 | New SPB | + |
| 193, 194 | 40 | 8 | 2 | New SPB | -- |
| 173, 174 | 40 | 8 | 2 | New SPB | -- |
| 59, 60 | 40 | 8 | 2 | New SPB | -- |
| 71, 72 | 40 | 8 | 2 | New SPB | - |
| 101, 102 | 40 | 8 | 2 | New SPB | - |
| 39, 40 | 40 | 8 | 2 | New SPB | + |
| 15, 16 | 40 | 8 | 2 | New SPB | - |
| 131, 132 | 40 | 8 | 2 | New SPB | -- |
| 95, 96 | 40 | 8 | 2 | New SPB | - |
| 143, 144 | 40 | 8 | 2 | SSW | -- |
| 393, 394 | 65 | 8 | 2 | New SPB | -- |
| 21, 22 | 40 | 8 | 2 | New SPB | -- |
| 255, 256 | 40 | 8 | 2 | New SPB | - |
| 215, 216 | 65 | 8 | 2 | New SPB | ++ |
| 175, 176 | 65 | 8 | 2 | New SPB | + |
| 203, 204 | 40 | 8 | 2 | New SPB | + |
| 253, 254 | 40 | 8 | 2 | SSW | ++ | outcome definitions in Table 9:
+ = greater than midpoint of Kappa Factor controls up to high Kappa Factor control
++ = greater than high Kappa Factor control
− = less than or equal to midpoint of Kappa Factor controls but not less than low Kappa Factor control
−− = less than low Kappa Factor control Term Key for Table 9: SPB=Spruce Pine Birch; SSW=Southern Softwood In the studies summarized in Table 9, for enzymes that exhibited performance below the low Kappa factor control, it is assumed that material in the enzyme sample contributed to lowering brightness. Removal of this material by enriching or further purifying the xylanase candidate in the enzyme sample could improve performance.

In one aspect, single amino acid residue mutations as described herein were combined to generate a xylanase enzyme having at least two, several or all of the point mutations, e.g., as described in Table 10, below. The "enzyme no." column in Table 10 correlates to the "enzyme no." column in FIG. 15, discussed below.

Table 10A, B, C: Combined Mutants, Point Upmutants, Short Blended Upmutants

TABLE 10A combined mutants

Amino Acid Position in SEQ ID NO:384

| Enzyme No. | 4 | 9 | 10 | 13 | 14 | 18 | 25 | 30 | 34 | 35 | 71 | 194 |
|---|---|---|---|---|---|---|---|---|---|---|---|---|
| Wild type | T | S | Q | T | N | Y | S | N | Q | S | S | S |
| 20 |   | P |   | Y | H | F | E |   | C | E | T | H |
| 21 |   | P |   |   | F | H | F |   | L | E | T |   |
| 22 |   |   | S |   | F | H |   |   | C | E | T | H |
| 23 |   | P |   |   | F | H |   | E | H | E |   | H |
| 24 |   | P | S |   |   | H | F | E | H | E | T | H |
| 25 |   | P | S | Y | H | F | E |   | L | E | T | H |
| 26 |   | P |   |   | F | H | F | E | C | E | T |   |
| 27 |   | P |   |   | F | H | F | E | C | E | T | H |
| 28 |   | P | S |   | F | H |   | E | V | C | E | T | H |
| 29 |   | P | S |   | Y | H | F | E |   | C | E | T | H |
| 30 |   | P |   |   | Y | H |   | E | V | L | E |   | H |
| 31 |   | P |   |   | Y | H |   | E | V | L | E | T | H |
| 32 |   | P | S |   |   | H | F | E |   | C | E | T |   |
| 33 |   | P | S |   |   | H | F | E | V | H | E | T |   |
| 34 |   | P | S |   | F | H | F | E |   | C | E |   | H |
| 35 |   | P | S |   | F | H | F | E |   | H | E | T | H |
| 36 |   | P |   |   | Y | H |   | E | L | E |   | T | H |
| 37 |   | P | S |   | Y | H | F | E |   | H | E | T | H |
| 38 |   | P | S |   |   | H | F | E | V | L | E | T |   |
| 39 |   | P |   |   | Y | H |   |   |   | C | E | T | H |
| 40 |   | P |   |   | Y | H |   | E |   | H | E | T |   |
| 41 |   | P |   |   | Y | H | F | E |   | C | E | T | H |
| 15 |   |   |   |   | Y |   | F |   |   |   |   | T |   |
| 16 |   | P |   |   |   | H | F |   |   | C | E |   |   |
| 17 | L |   |   |   |   | H |   | E |   | C | E |   |   |

TABLE 10B

Point upmutants

| | Mutation | Codon |
|---|---|---|
| 1 | T4L | CTT |
| 2 | S9P | CCC |

TABLE 10B-continued

Point upmutants

| | Mutation | Codon |
|---|---|---|
| 3 | Q10S | TCA |
| 4 | T13Y | TAC |
| 5 | T13F | TTT |
| 6 | T13W | TGG |
| 7 | Y18F | TTC |
| 8 | S25E | GAG |
| 9 | Q34L | TTG |
| 10 | Q34H | CAT |
| 11 | Q34C | TGT |
| 12 | S35E | GAG |
| 13 | S71T | ACA |
| 14 | S194H | CAT |

TABLE 10C

Short blended upmutants

| | |
|---|---|
| 15 | 13Y 18F 71T |
| 16 | 9P 14H 18F 34C 35E |
| 17 | 4L 14H 25E 34C 25E |

FIG. 15 is a table summarizing data demonstrating enzymatic activity of exemplary enzymes of the invention having sequences as set forth in Table 10, above, where it is indicated that all of these enzymes are sequence variations of SEQ ID NO:384, as set forth in Table 10. For example, in "enzyme 20": amino acid position 9 is a P, or a proline (where the "wild type", or SEQ ID NO:384, is an S, or a serine), amino acid position 13 is a "Y", or a tyrosine (where the "wild type", or SEQ ID NO:384, is an T, or a threonine), etc. Unless otherwise specified, all the studies were done on Northern softwood brownstock pulp (e.g., SSWB is Southern softwood brownstock pulp). High/low kappa factors are indicated. Methodology is discussed above (e.g., for stage "X", "Do" and "E1", or "Ep", see explanation in Examples 9 and 10, above). Brightness and "chemical savings" are indicated; "chemical savings" indicating less use of chemical bleach such as chlorine (elemental chlorine or chlorine dioxide), sodium hydrosulfite and/or and sodium hypochlorite in a second, bleaching chemical step where a hemicellulolitic enzyme of the invention (xylanase) is initially used to degrade (hydrolyze) hemicellulose, and a second bleaching chemical step is used to degrade remaining lignin).

As noted above, the enzymes and processes of the invention can also be used in conjunction with a second approach to enzymatic bleaching using oxidative enzymes such as laccase and/or manganese peroxidase (MnP) to delignify pulp. Of these enzymes, laccase is preferred, because MnP requires hydrogen peroxide, manganese (II) ions and a chelator. Laccase can cause delignification of pulp under slight oxygen pressure, but is considerably more effective when mediators are added, as discussed above.

Catalyst improved delignification methods can also be used in conjunction with the methods of the invention, for example, polysulfide or anthraquinone. Anthraquinone is a pulping reaction catalyst which can increase the speed of pulping, increase yield, and reduce pulping chemical usage by up to 10%. It is possible to use both anthraquinone and polysulfide together.

In one aspect, laccase is used in conjunction with the methods of the invention, as discussed above. For example, laccase is used in an oxygen reactor in a process of the invention, where the laccase breaks down the lignin in the oxygen reactor. While pulp may release various components that self-mediate the laccase, in one aspect organic or inorganic mediators are added (see discussion above, e.g., alternative exemplary mediators include 2,2'-azinobis(3-ethylbenzth-iazoline-5-sulphonate) (ABTS) as an exemplary organic mediator and potassium octacyanomolybdate [$K_4Mo(CN)_8$] as an exemplary inorganic mediator, or mediators as described in U.S. patent application no. 20030096394). In one aspect, another hydrolase, such as an esterase (e.g., a lipase) and/or an oxidoreductase (e.g., a peroxidase) is also added. In alternative aspects, pH and/or temperature are modified in the reactor.

Example 11

Studies Demonstrating the Enzymatic Activity of SEQ ID NO:382

This example describes studies demonstrating the enzymatic activity of the exemplary xylanase enzyme of the invention having an amino acid sequence as set forth in SEQ ID NO:382 (encoded, e.g., by SEQ ID NO:381).

The enzymatic activity of SEQ ID NO:382 was demonstrated on Southern Softwood (SSWB), the enzyme's performance on SSWB summarized in FIG. 16, FIG. 17, FIG. 18 and FIG. 19.

For Brownstock: SEQ ID NO:382 performed very well in the temperature range 40-70° C., and in the pH range 5-8. Chemical savings under these conditions ranged form 18% to 22%. SEQ ID NO:382's stability allowed it to perform on SSWB at temperatures up to 90° C., pH 8 (chemical savings depend upon conditions).

For Post-$O_2$, SSW-$O_2$ required as little as 0.05 U SEQ ID NO:382 per gram of OD pulp. SEQ ID NO:382 exhibited excellent stability to a variety of process conditions, including temperature, pH, solids %, treatment time, when used to pre-treat SSW-$O_2$. Chemical savings can exceed 22% (Do-stage savings only) on SSW-$O_2$.

Figure 16:
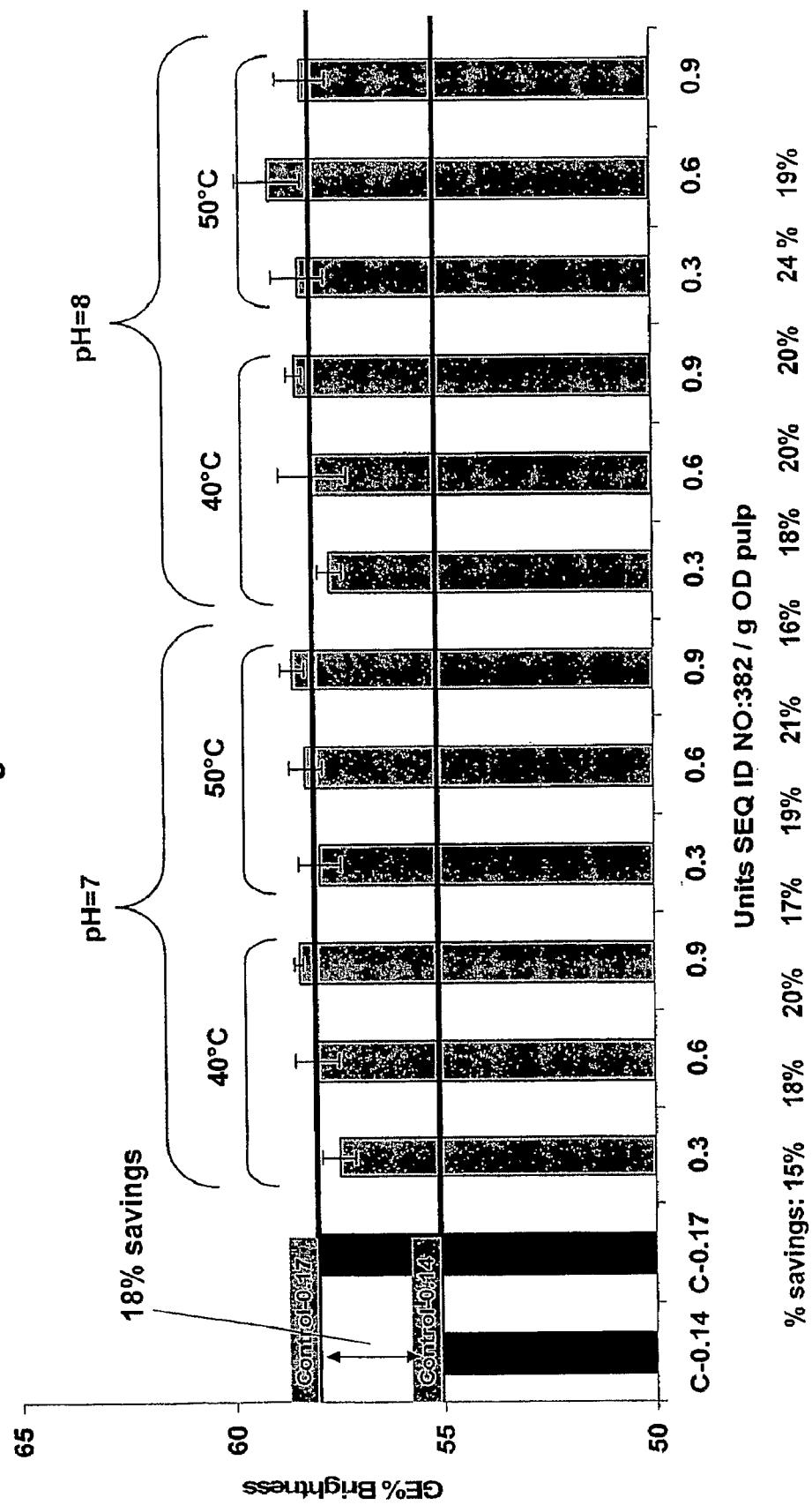
FIG. 16, FIG. 17, FIG. 18 and FIG. 19 are tables graphically illustrating SEQ ID NO:382 activity on Southern Softwood (SSWB) under various conditions, and summarizing this data, as described in detail in Example 11, below.

FIG. 16 is a table illustrating SEQ ID NO:382 activity and summarizing (X)DoEp data (see above for detailed explanation) on SSWB 0803 (Kappa #22.8); X:10% solids and 60 min.; Pulp filtrate adjusted to desired pH—unbuffered system. In FIG. 16, SEQ ID NO:382, demonstrated activity at 0.6 U/g OD pulp, which provided an 18% chemical savings.

Figure 17:
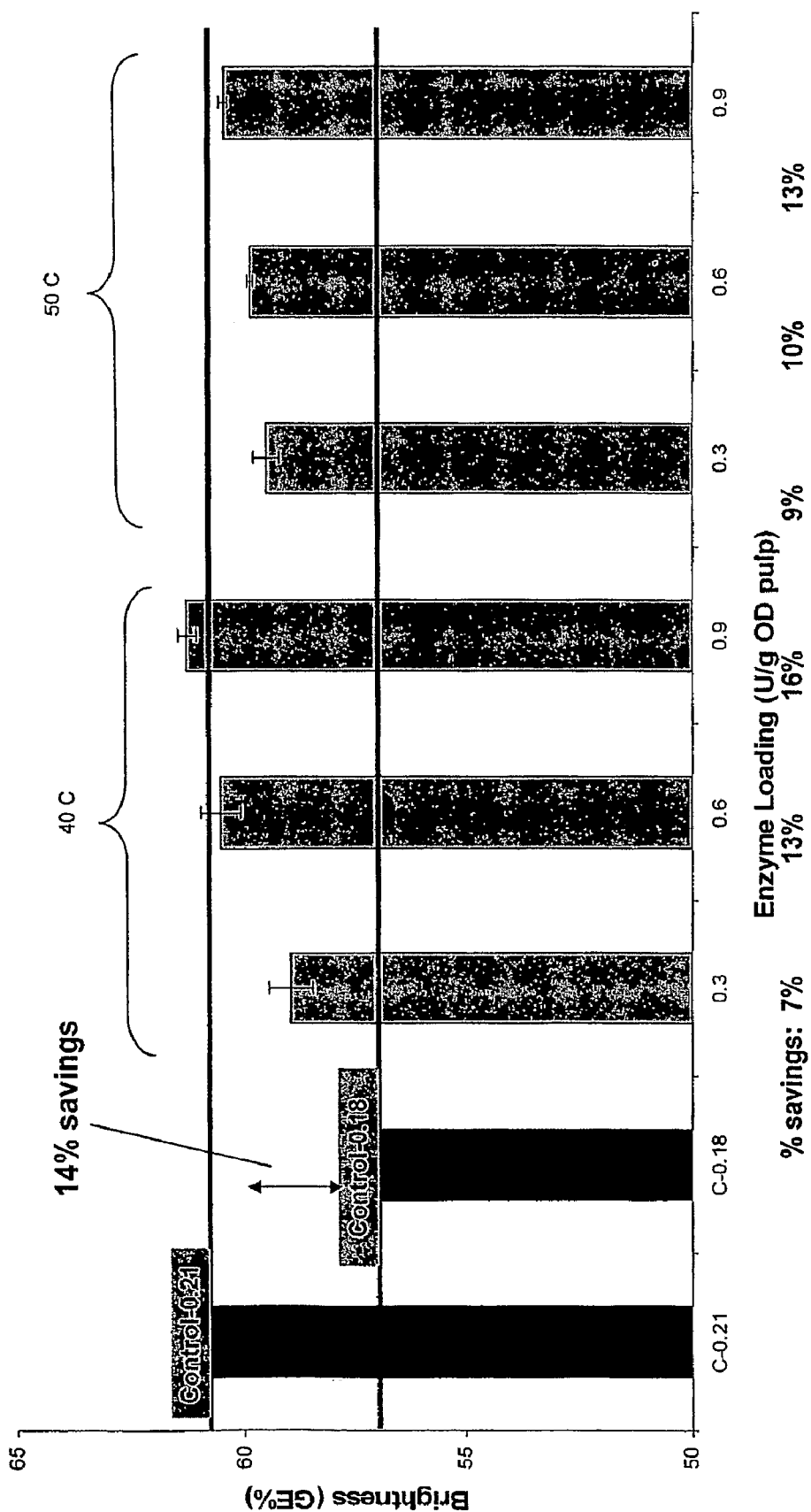

FIG. 17 is a table illustrating SEQ ID NO:382 activity and summarizing (X) DoEp data on SSWB 0803 (Kappa #22.8); X: pH=8 and 30 min, 10% solids; Pulp filtrate adjusted to pH 8—unbuffered system. In FIG. 17, SEQ ID NO:382, demonstrated activity that provided a 14% savings at 0.9 U/g, 40° C. and 50° C., pH 8, 30 min on SSWB-GP Brunswick.

Figure 18:
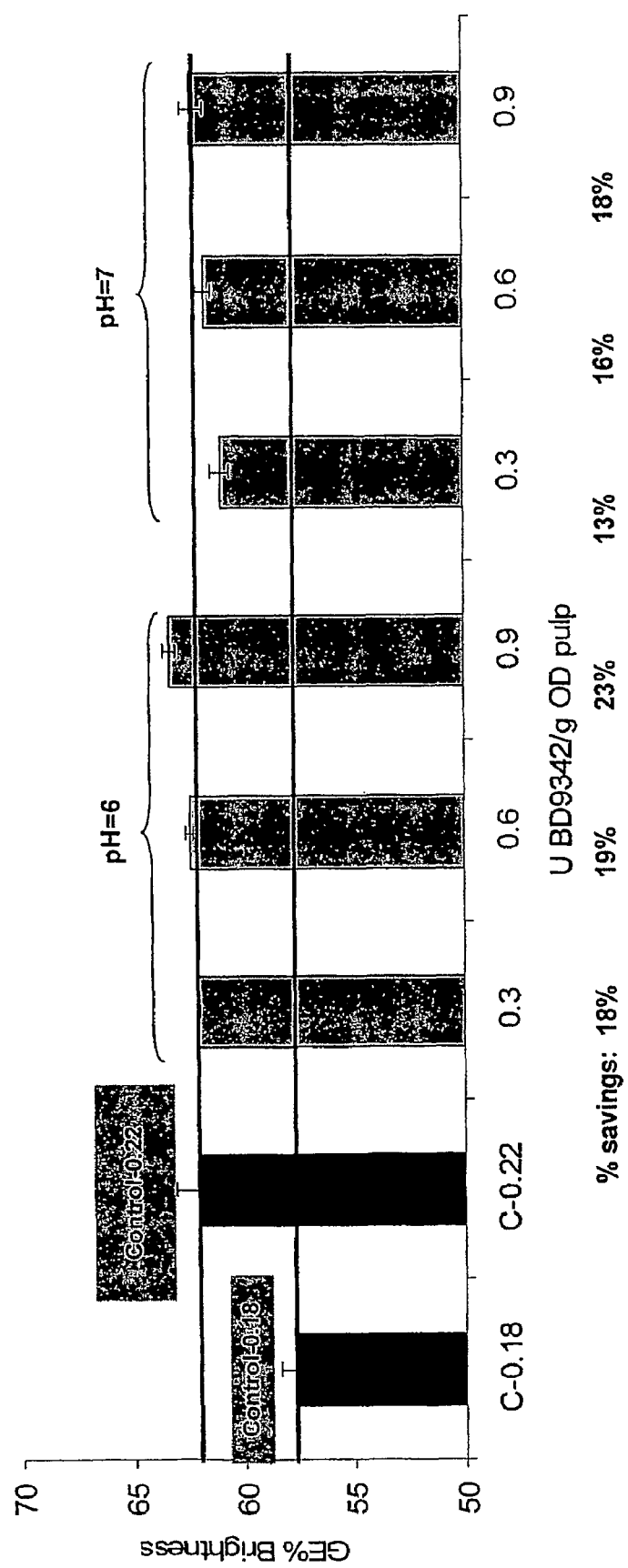

FIG. 18 is a table illustrating SEQ ID NO:382 activity and summarizing (X) DoEp data on SSWB 0803 (Kappa #22.8); X: 40° C., 30 min and 10% solids; Pulp filtrate adjusted to desired pH—unbuffered system. In FIG. 18, SEQ ID NO:382, demonstrated activity showing that pretreatment of SSWB-Brunswick with SEQ ID NO:382 provided an 18% chemical savings and showed a slightly better performance at a lower pH (pH 6), 40° C., 30 min.

Figure 19:
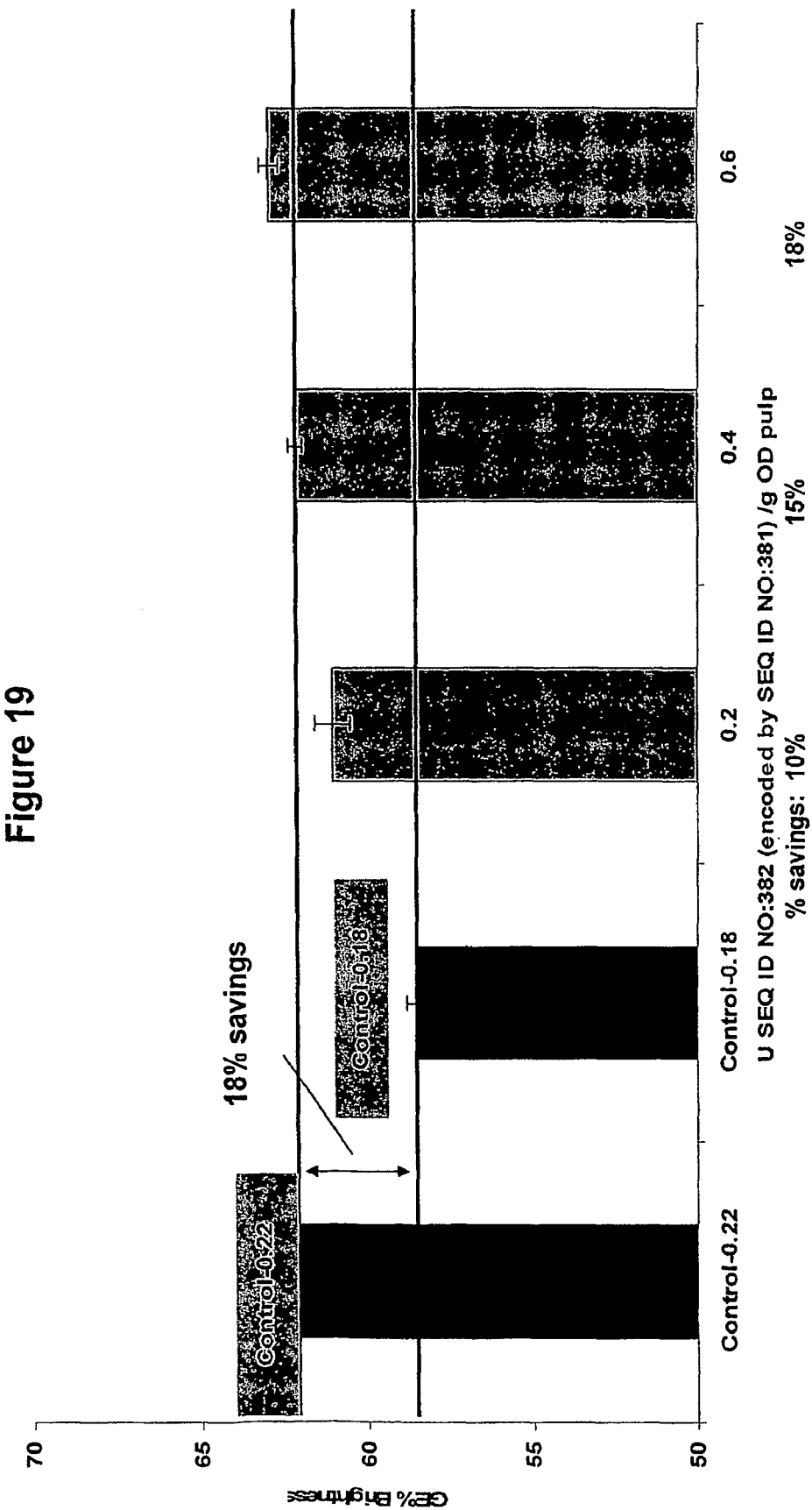

FIG. 19 is a table illustrating SEQ ID NO:382 activity and summarizing (X) DoEp data on SSWB 0803 (Kappa #22.8); (X) DoEp on SSWB (Kappa #28.6) X: 40° C., pH=7, 30 min and 4.5% solids; Pulp filtrate adjusted to desired pH—unbuffered system. In FIG. 19, SEQ ID NO:382, demonstrated activity showing that pretreatment of SSWB-Brunswick with SEQ ID NO:382 at 4.5% solids provided 18% chemical savings.

Figure 20:
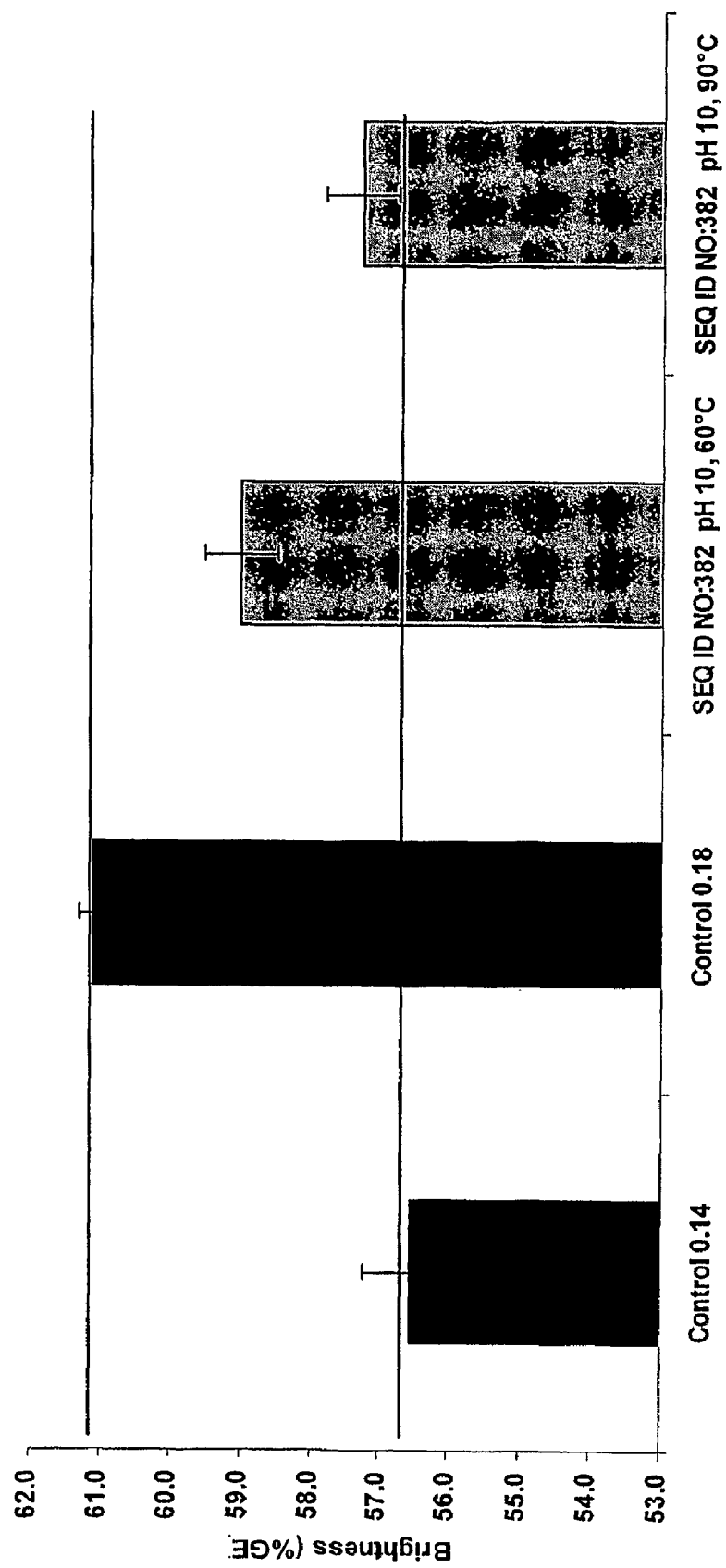
FIG. 20 is a table graphically illustrating SEQ ID NO:382 activity on post-$O_2$ Northern Hardwood (NHW) in various pH ranges, as described in detail in Example 11, below.

FIG. 20 is a table illustrating that SEQ ID NO:382 is also effective on post-$O_2$ Northern Hardwood (NHW) in the pH range of 6-8.5, retaining activity even at pH 10; 60° C. and 90° C. In FIG. 20, (X) DoEp biobleaching of NSWB Northwood (Kappa #24.8) X: 0.7 U/g, pH=10, 60 min, 10% solids.

In summary: SEQ ID NO:382 is active on all pulp types tested, including, e.g., softwood, hardwood, low kappa, high kappa, etc.; SEQ ID NO:382 has a high tolerance for process condition variation, including, e.g., temperature, pH, % solids, treatment time; SEQ ID NO:382 performs over a wide range of operating temperatures (from 39° C. to 90° C.), with best performance up to 70° C.; SEQ ID NO:382 is active over a broad pH range (at least the tested pH 5.2-10.0) and optimal in the range pH 6.0-8.0; SEQ ID NO:382 can achieve the desired prebleaching effect in approximately 20 minutes, allowing enhanced feed rates; and, SEQ ID NO:382 performs well at various pulp consistencies (about 3% to 10%), allowing an increased feed option during X-stage.

Example 12

Studies Demonstrating the Enzymatic Activity of Enzymes of the Invention

This example describes studies demonstrating the enzymatic activity of the exemplary xylanase enzymes of the invention, including the exemplary enzymes of the invention having the amino acid sequences of SEQ ID NO:482 (encoded, e.g., by SEQ ID NO:481), SEQ ID NO:490, SEQ ID NO:502, SEQ ID NO:504 and SEQ ID NO:512. Activities at pH 10 and at temperatures of 45° C., 50° C., and 55° C. for the exemplary xylanase of the invention having the amino acid sequence SEQ ID NO:512 is described.

An exemplary assay for evaluating these xylanases:

1. Initial Screen—Using an Azo-Xylan (Solution-Based) Substrate a. Discovery hits were subcloned into a suitable expression vector b. Xylanase subclones were expressed in 1 L shakeflasks under standard conditions c. The expression levels of subclones were determined by SDS-PAGE.

d. The level of enzymatic activity of enzymes were determined by Azo-xylan assay using Megazyme® substrate Birchwood Azo-xylan in 100 mM sodium phosphate, pH 8, according to manufacturer's recommended assay protocol. The concentrations of enzyme samples were adjusted such that they had equal amounts of xylanase activity at pH8.

e. The azo-xylan assay was then repeated with normalized samples in 100 mM sodium borate buffer at pH 10.4.

Figure 21:
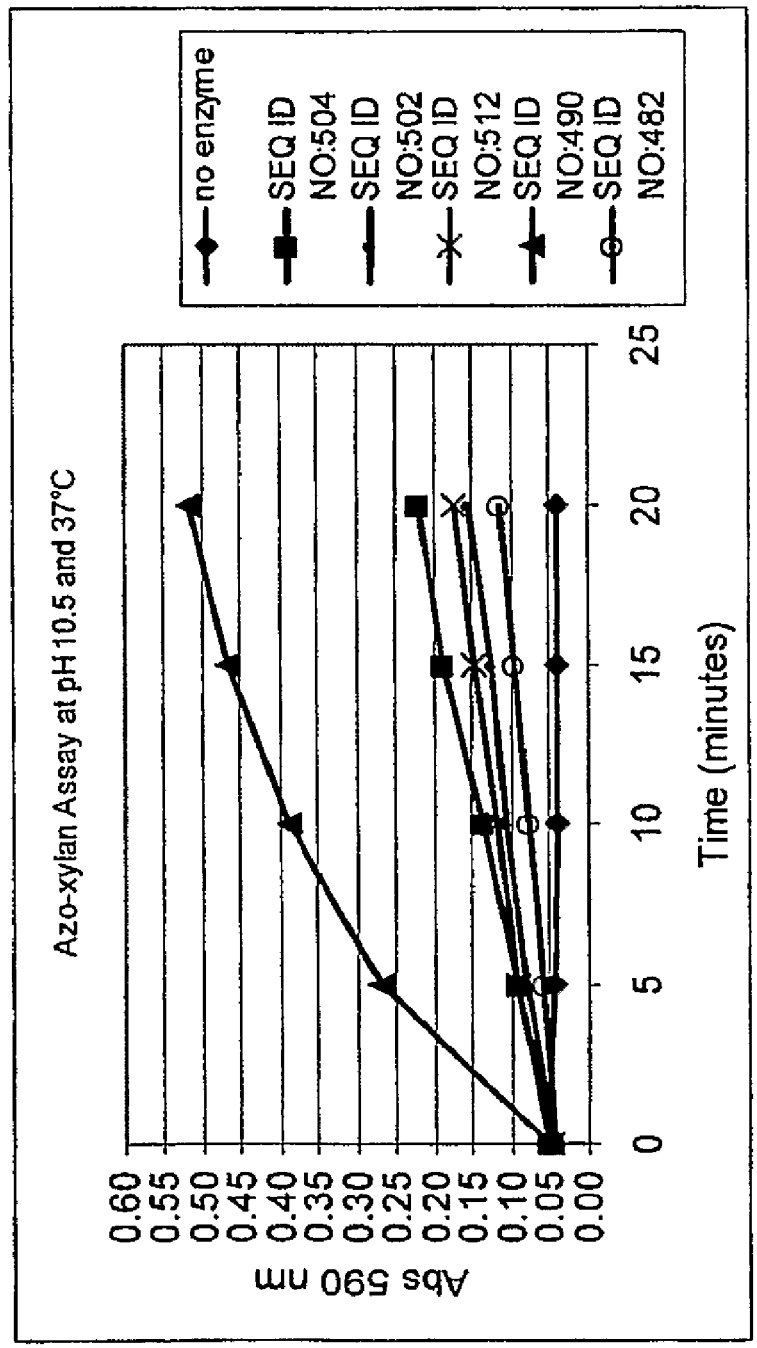
FIG. 21 graphically illustrates the results of an azo-xylan assay using the exemplary enzymes of the invention, as described in detail in Example 12, below.

Azo-xylan assay data from this protocol using the exemplary enzymes of the invention having the amino acid sequences of SEQ ID NO:482, SEQ ID NO:490, SEQ ID NO:502, SEQ ID NO:504 and SEQ ID NO:512, is shown in FIG. 21.

Figure 22:
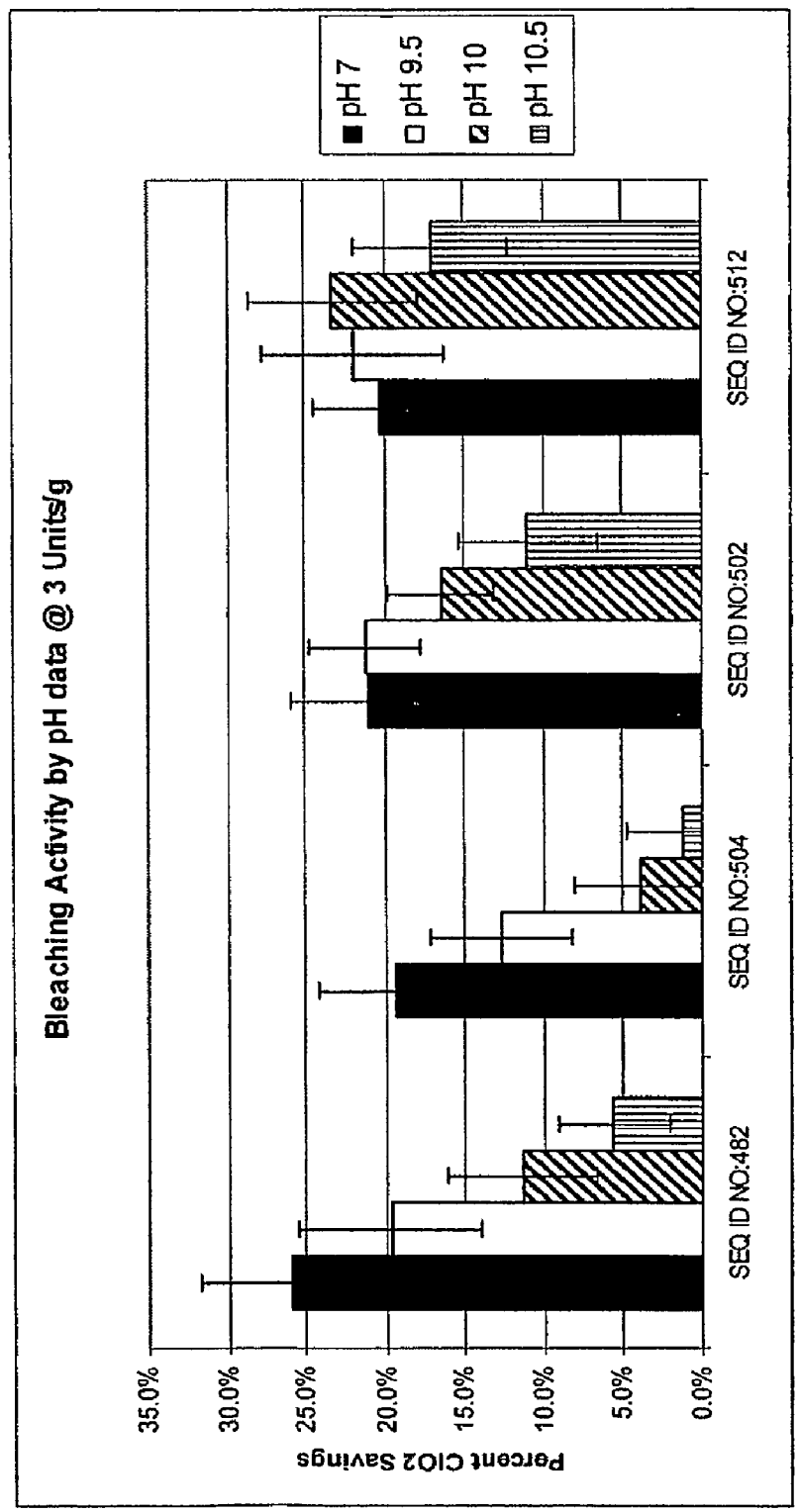
FIG. 22 and FIG. 23 graphically illustrate the results of an exemplary enzyme activity assay using the exemplary enzymes of the invention on wheat arabinoxylan using a Nelson-Somogyi assay, as described in detail in Example 12, below.
Figure 23:
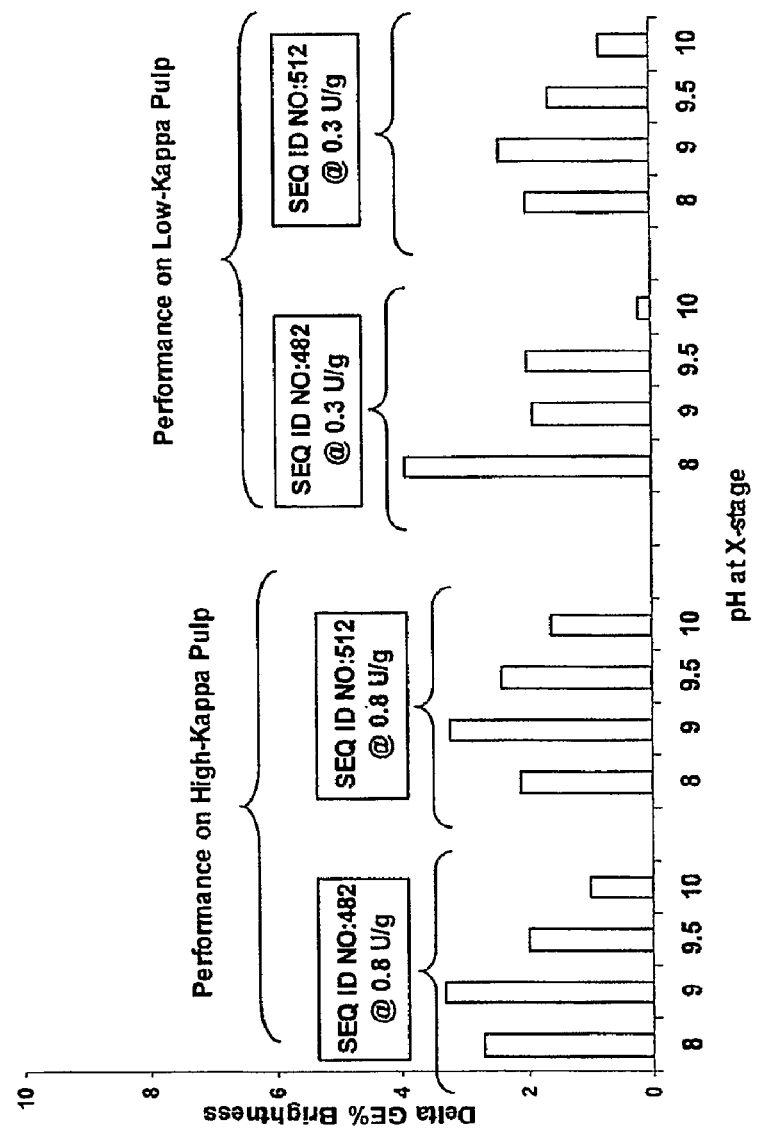
Figure 24:
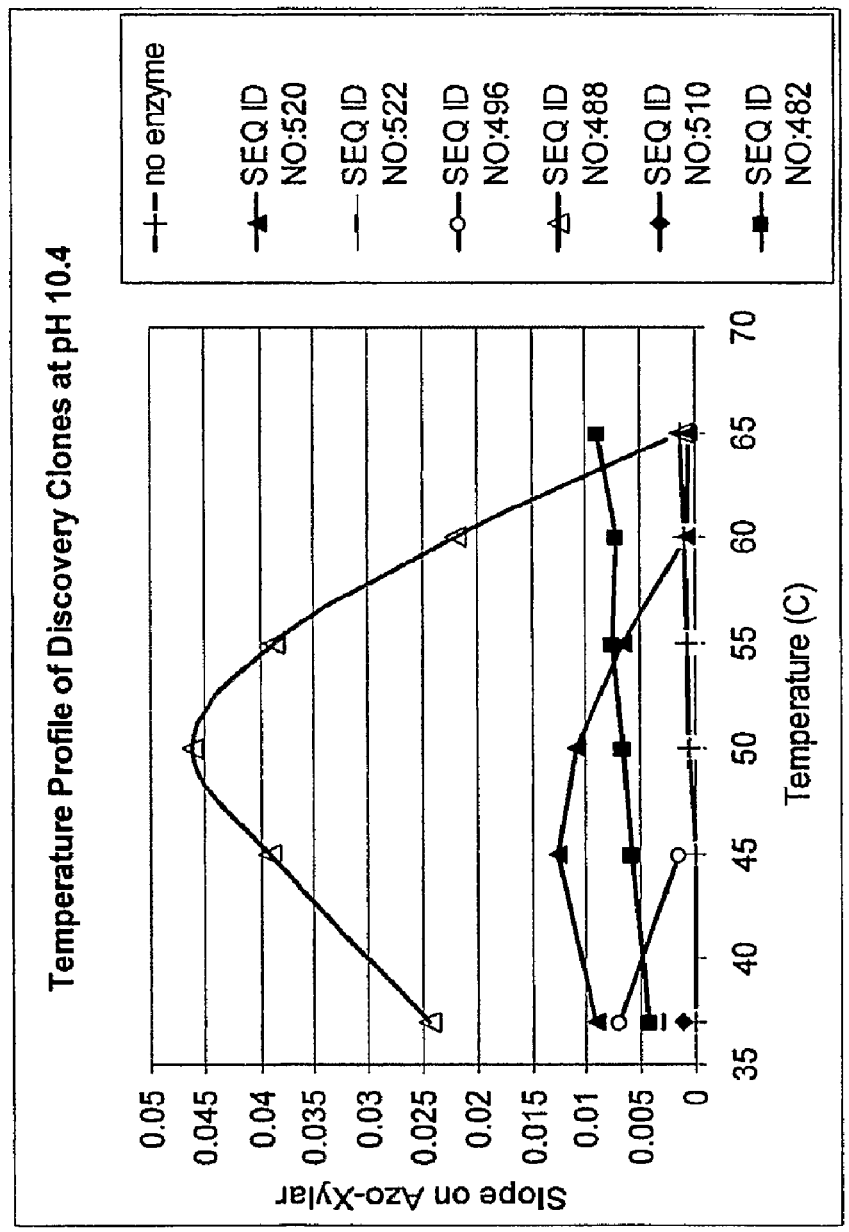
FIG. 24 and FIG. 25 graphically illustrate the results of an exemplary thermotolerance assay for xylanases using an azo-xylan assay, as described in detail in Example 12, below.
Figure 25:
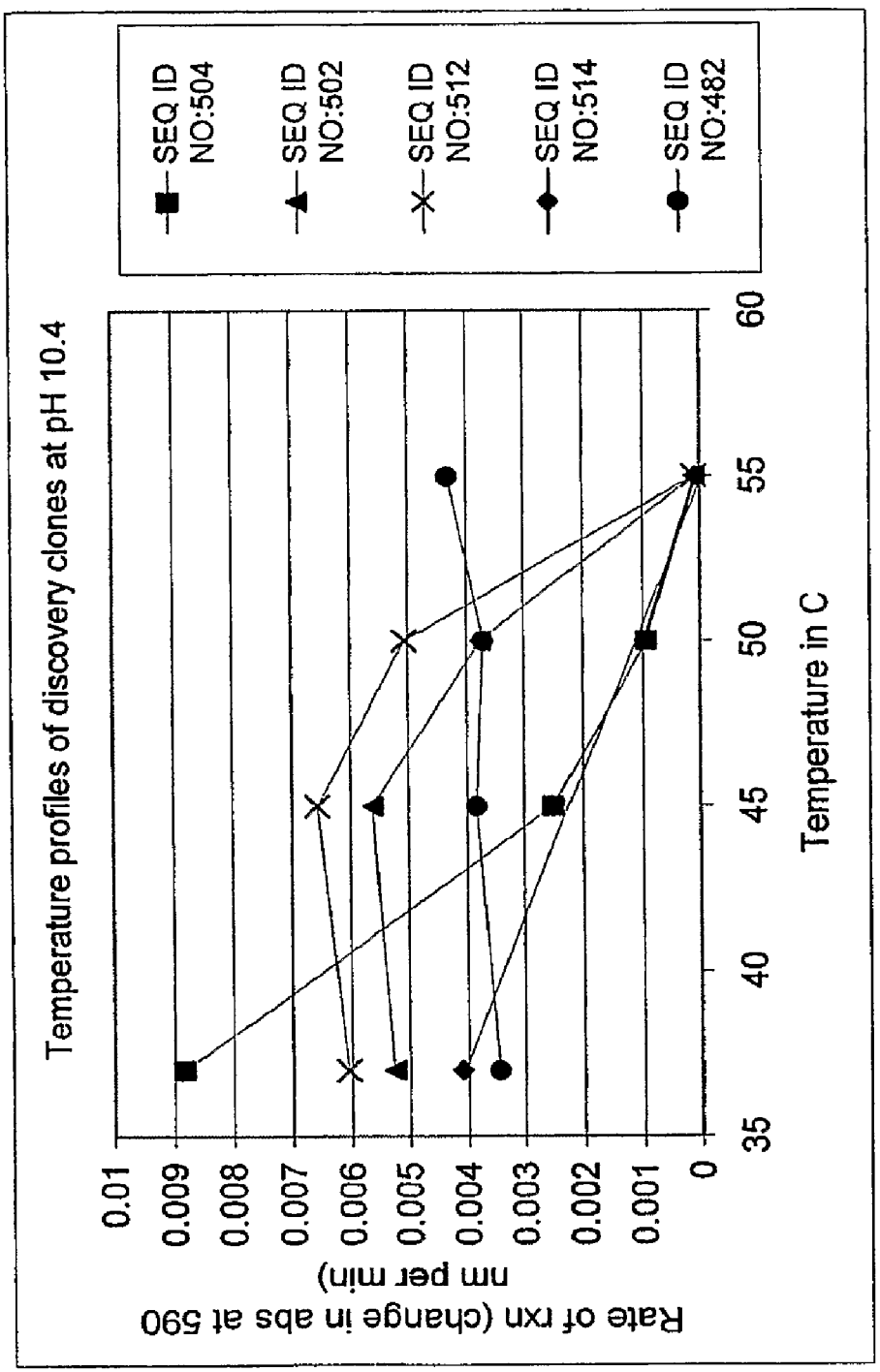
Figure 26:
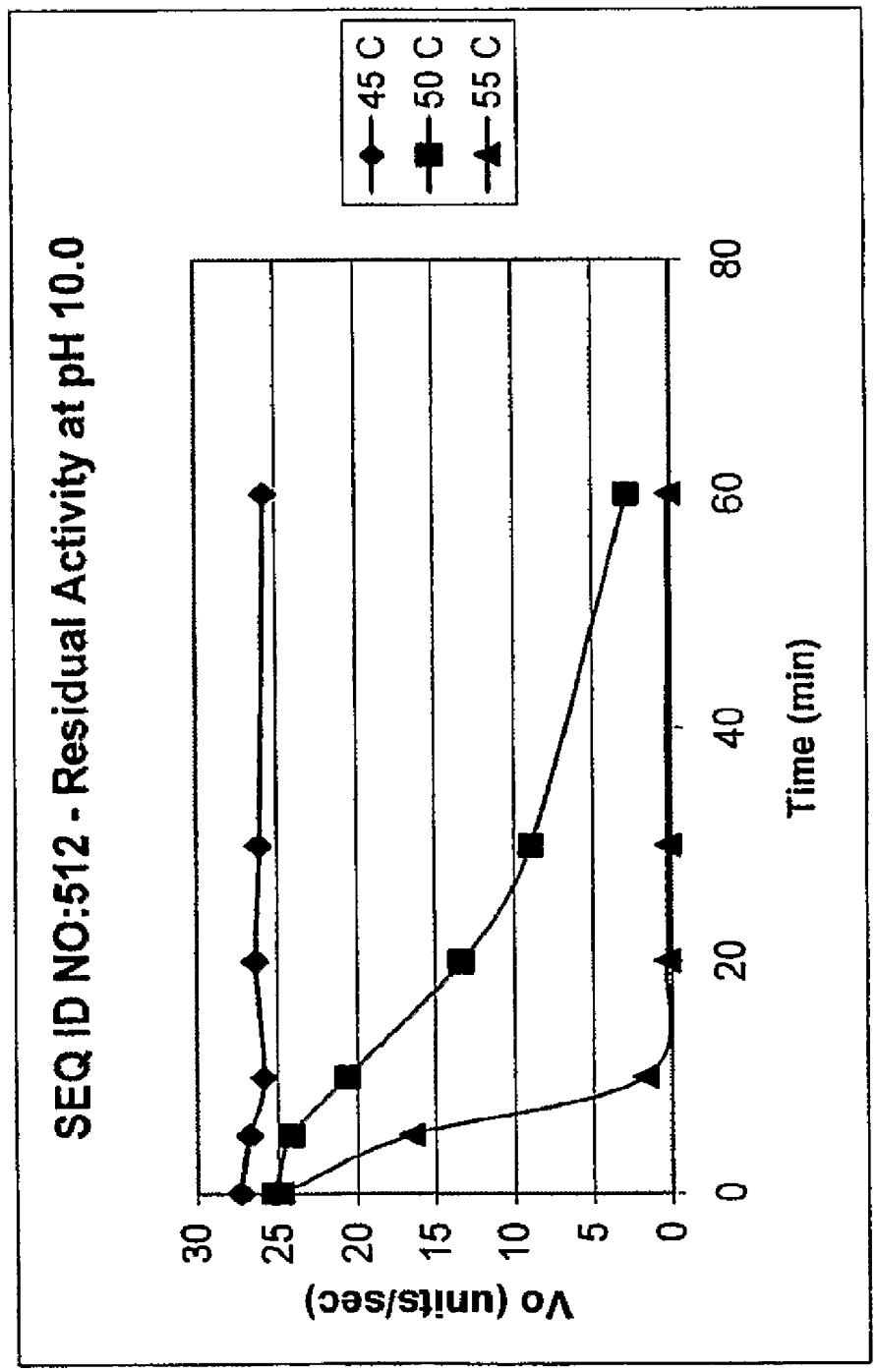
FIG. 26 graphically illustrate the results of an exemplary thermotolerance assay for enzymes, a residual activity method, as described in detail in Example 12, below.

2. Initial Screen—ENZ-CHEK ULTRA XYLANASE ASSAY KIT™ (Invitrogen)
  a. Xylanase enzyme samples were prepared in the same manner as for the Azo-xylan assay (section 1, above).
  b. The level of enzymatic activity of enzymes was measured by employing commercially available assay kit sold by Invitrogen under the name ENZ-CHEK ULTRA XYLANASE ASSAY KIT™ (Product number E33650). The ENZ-CHEK™ kit substrate produces fluorescent signal in the presence of xylanases, which can be used to quantify xylanase activities using kit-supplied standards. The protocol used for testing xylanase enzymes was slightly modified manufacturer-recommended protocol. The modifications primarily involved testing xylanases at different pH and temperature that what is recommended by the manufacturer.
3. Secondary Screen—Exemplary Pulp Assays
  a. The enzymes from azo-xylan assay were tested for activity on wheat arabinoxylan using Nelson-Somogyi assay as already described herein. They were then tested in a laboratory scale bleaching assays to determine the amount of chemical savings each can achieved for a given pulp type and chlorine dioxide loading. The ones that met desired performance characteristics were tested in TAPPI bag biobleaching assay in triplicate at a range of loadings and pH levels.
  b. Typical data for this assay is shown in FIG. 22 and FIG. 23.
4. Exemplary Enzyme Characterization Screen—Temperature Profile
  a. Thermotolerance of xylanases can be assayed using azo-xylan assay at pH 8 and pH 10.4 at progressively more elevated temperatures; and enzymes of the invention were tested using this assay. The initial rates of reaction at each temperature were recorded and plotted to determine optimal performance temperature of xylanases. Typical thermal profile plots is shown in FIG. 24 and FIG. 25.
  b. Residual activity—Another exemplary assay that can be employed for testing thermostability of enzymes is the residual activity method, whereby a sample of enzyme is treated at an elevated temperature at a particular pH for a specific period of time, and then assayed under standard conditions under permissive temperature (typically 37° C.). A half-life at a particular temperature is then determined and provides a measure of a given enzyme fitness under those temperature conditions. A plot of residual activities at pH 10 and temperatures of 45° C., 50° C., and 55° C. of one of the exemplary xylanase of the invention having the amino acid sequence SEQ ID NO:512 is shown in FIG. 26.

Example 13

Crystallization and Data Collection for Structure Analysis

This example describes and demonstrates crystallization and data collection, and structure analysis, for the exemplary xylanase of the invention having the amino acid sequence SEQ ID NO:482 (encoded, e.g., by SEQ ID NO:481).

Crystallization and Data Collection

Crystals of SEQ ID NO:482 (21 g/l in ddH$_2$0) were grown at 20° C. in 55% (w/v) PEG 400, 0.15 M lithium sulphate, 0.1 M tri-sodium acetate (pH 5.1). Crystals grew over a period of two to three days and were cryo-protected in the mother liquor. Crystals of SEQ ID NO:382 (encoded by SEQ ID NO:381) (21 g/l in ddH$_2$0) were grown at 20° C. in 12% (w/v) PEG 8000, 0.1 M Tris/HCl (pH 9). Crystals were also observed after two to three days and cryo-cooled in the mother liquor containing an additional 30% (v/v) glycerol. Diffraction data to a maximum resolution of 1.8 Å for SEQ ID NO:382 and 1.9 Å for SEQ ID NO:482 were recorded from single crystals at 100 K using a RAXIS-IV image plate detector mounted on a MicroMax 007 (copper 1.5418 Å) rotating anode X-ray source. The diffraction data were integrated in MOSFLM and scaled in SCALA. All other calculations were carried out with programs from the CCP4 suite. Both datasets contained a total of 250 images each and were collected with an oscillation angle of 1°.

Structure Solution

The diffraction data revealed that crystals of SEQ ID NO:482 belonged to space group C2, with unit cell dimensions of a=64.7 Å, b=33.6 Å, c=83.1 Å, α=90.00°, β=101.90°, γ=90.00°, and with one molecule occupying the crystallographic asymmetric unit. The structure of SEQ ID NO:482 was solved by molecular replacement in MOLREP using a previously determined structure of the *Bacillus circulans* XynA (PDB accession number 1xnb; PDB is the Protein Data Bank available from the Research Collaboratory for Structural Bioinformatics (RCSB) website), as the search model. Rounds of manual rebuilding in Coot were interspersed with restrained refinement in REFMAC. Solvent water molecules were added using Arp_waters, and checked manually using Coot.

Diffraction data resulting from the crystals of SEQ ID NO:382 belonged to space group P2$_1$2$_1$2$_1$, with unit cell dimensions of a=36.3 Å, b=63.2 Å, c=75.1 Å, α=90.00°, β=90.00°, γ=90.00, also with one molecule occupying the crystallographic asymmetric unit. The structure of SEQ ID NO:382 was solved by molecular replacement in MOLREP using the structure of the SEQ ID NO:482 as the search model. Refinement was then carried out in a similar manner to the SEQ ID NO:482.

Example 14

Enzymatic Activity and Characterization of Enzymes of the Invention

This example describes various characteristics of exemplary xylanase enzymes of the invention, and exemplary assays for making those determinations.

The M$_r$ of the mature exemplary enzyme of the invention SEQ ID NO:382 was 23 kDa was determined by SDS-PAGE. The size of the native enzyme, estimated by size exclusion chromatography, was 25 kDa, indicating that the enzyme is monomeric. SEQ ID NO:382 rapidly hydrolyses oat spelt xylan with a k$_{cat}$ of 155000±2700 min$^{-1}$ and K$_m$ of 2.6±1.4 mg/ml. The enzyme displayed significant thermostability and is not subject to thermal inactivation up to 70° C. Differential Scanning Calorimetry (DSC) (described in detail, above) showed that the xylanase had a melting temperature of 74.2° C. The thermodynamics of unfolding could not be investigated as thermal unfolding of the protein was irreversible; it was not possible to obtain a refolding scan, and there was evident precipitation of the protein. Attempts at measuring the ΔG between the folded and unfolded form of the xylanase was also unsuccessful as circular dichroism and fluorescence spectroscopy revealed that the protein could not be denatured even when incubated for three months in 6 M guanidine hydrochloride at 37° C.

The single amino acid mutants S9P, N14H, T13F, Y18F, Q34L, S35E and S71T and the exemplary enzyme of the invention SEQ ID NO:482 were purified to electrophoretic homogeneity by anion exchange chromatography. The activity of these mutants showed that they all specific activities that were not compromised relative to the "wild type" enzyme, which was gratifying as changes to enzyme structure that increase stability often result in decreased catalytic efficiency. The retention of full catalytic activity reported here likely reflects the screening strategy employed.

Figure 27:
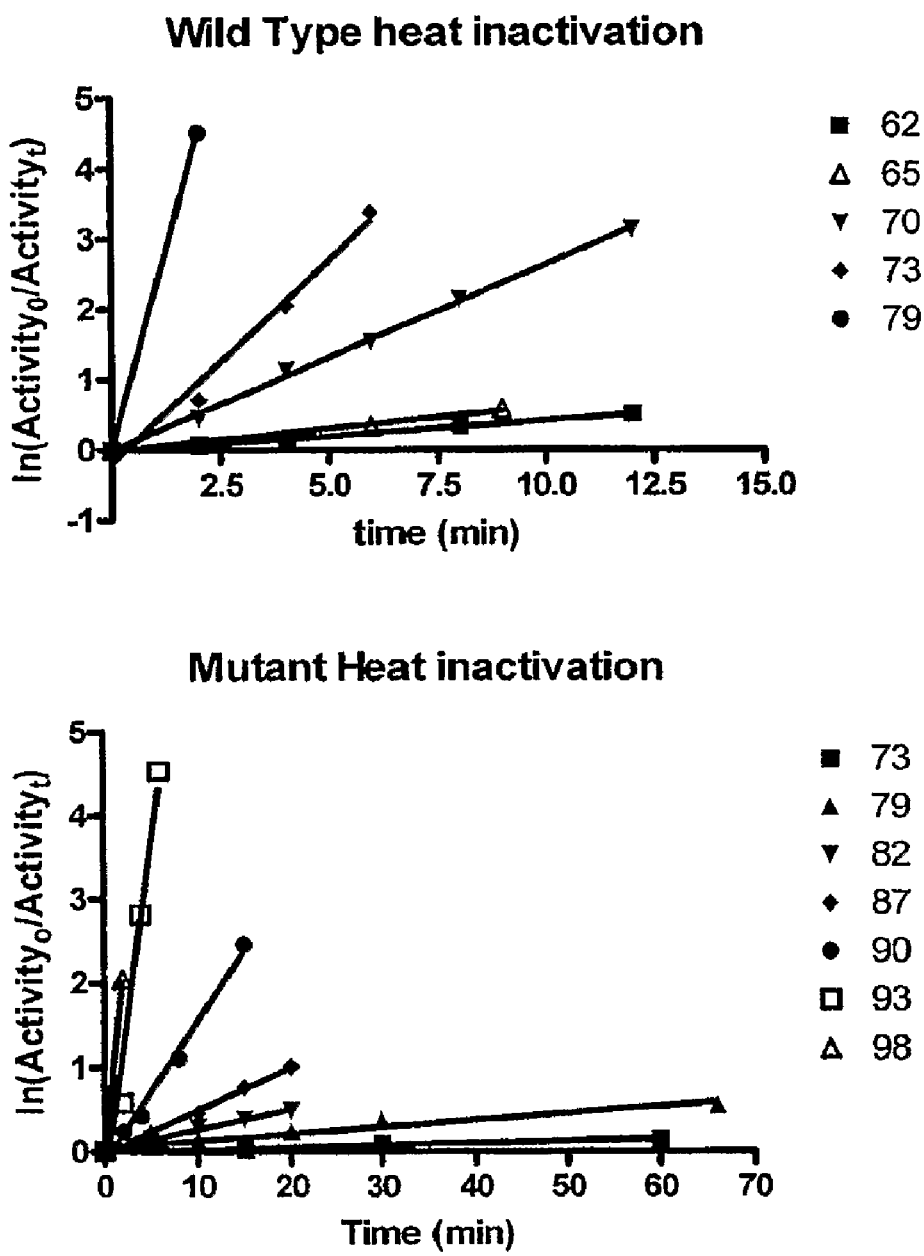
FIG. 27A and FIG. 27B illustrate data showing the thermal inactivation of the "wild type" of exemplary xylanase of the invention SEQ ID NO:382, and the variant or "mutant" exemplary xylanase of the invention SEQ ID NO:482, as described in detail in Example 14 below.

Differential Scanning Calorimetry (DSC) of the xylanase mutants showed that all variants containing a single amino acid change displayed elevated $T_m$s ranging from 2-11° (degrees) above that of the "wild type" enzyme. The combined "mutant" exemplary xylanase of the invention SEQ ID NO:482 had a $T_m$ of 103° C. which is 29° higher than the parent xylanase. To investigate the resistance to thermal inactivation SEQ ID NO:382 and SEQ ID NO:482 were heated for 15 min at various temperatures and assayed at the permissive temperature of 37° C.; see FIG. 27, illustrating the thermal inactivation of the "wild type" of exemplary xylanase of the invention SEQ ID NO:382, and the variant or "mutant" exemplary xylanase of the invention SEQ ID NO:482. The two enzymes were incubated at the various temperatures shown, aliquots were removed at various time points and assayed for residual xylanase activity at 37° C. using 4-nitrophenyl-β-Dxylotrioside as the substrate.

The pseudo-first order rate constants for thermal inactivation at 79° C. were 0.573±0.054 $min^{-1}$ and 0.0026±0.00029 $min^{-1}$ for the exemplary SEQ ID NO:382 and SEQ ID NO:482, respectively. Collectively, the thermal inactivation studies are consistent with the $T_m$ data in demonstrating that the seven mutations introduced into SEQ ID NO:382 to generate SEQ ID NO:482 greatly increased the thermostability of the xylanase.

Figure 28:
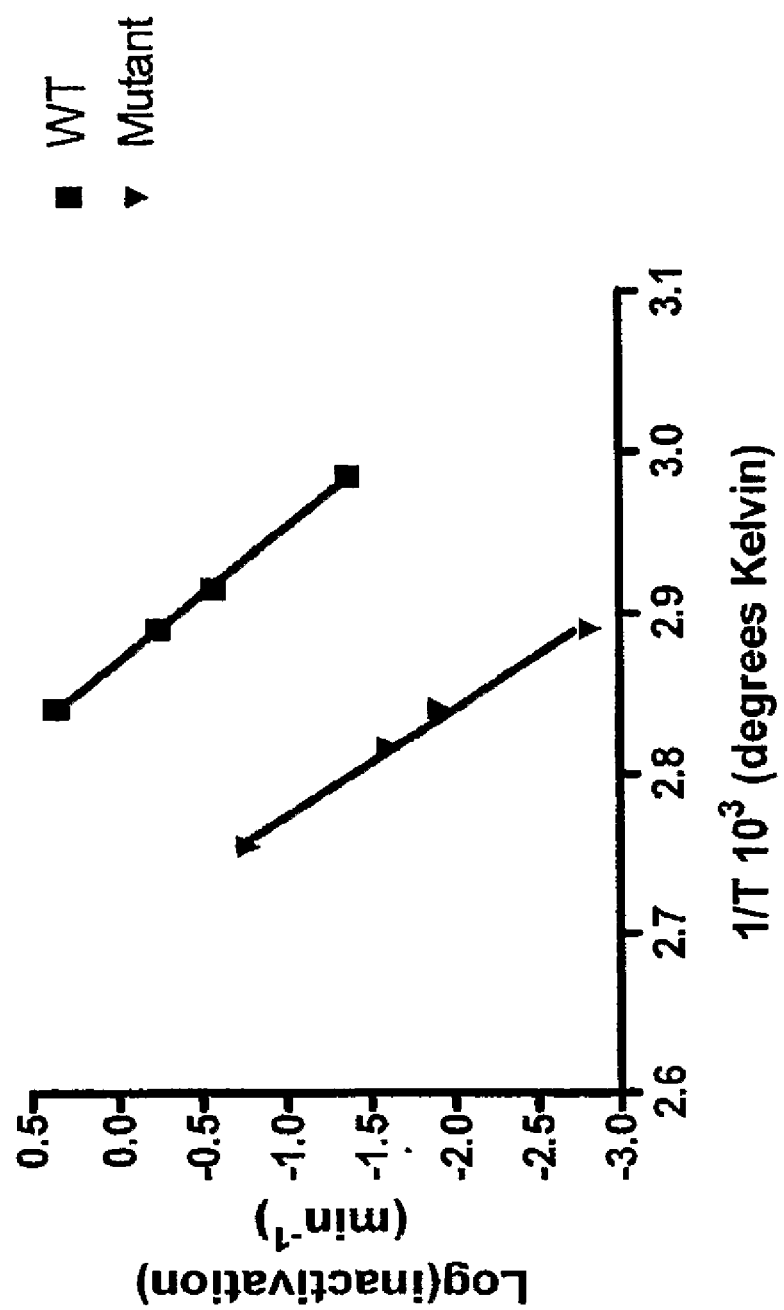
FIG. 28 illustrates data showing the difference in energy of inactivation of the exemplary SEQ ID NO:382 and SEQ ID NO:482, where the thermal inactivation was measured at several temperatures and the data were used to construct an Arrhenius plot, as described in detail in Example 14 below.

To explore the difference in energy of inactivation of the exemplary SEQ ID NO:382 and SEQ ID NO:482, the thermal inactivation was measured at several temperatures and the data were used to construct Arrhenius plots; see FIG. 28 illustrating this Arrehenius plot: the log of the pseudo 1st order inactivation rate was plotted against the reciprocal of the temperature. The slope of the lines gives the energy of inactivation. The inactivation energy of SEQ ID NO:482 (68.6 kcal $mol^{-1}$) is increased compared to the wild type enzyme (54.5 kcal $mol^{-1}$) by 14.1 kcal $mol^{-1}$. It was not possible to explore the ΔG of unfolding of SEQ ID NO:482 as guanidiane hydrochloride did not denature the protein even after extended incubation at elevated temperatures.

To explore the mechanism by which the amino acid substitutions increased the thermal stability of the exemplary enzyme of the invention SEQ ID NO:482, the crystal structure of both the "wild type" enzyme (the exemplary enzyme of the invention SEQ ID NO:382) and SEQ ID NO:482 were determined, at a resolution of 1.8 Å and 1.9 Å, respectively, by molecular replacement using the *Bacillus circulans* xylanase XynA (PDB accession number 1xnb), which displays 59% sequence identity with SEQ ID NO:382) as the search model. Amino acids extending from Gln-3 Gly-197 were clearly visible in the crystal structure indicating that the three N-terminal residues of the cloned enzyme were highly disordered or had been proteolytically processed. The "wild type" enzyme (the exemplary enzyme of the invention SEQ ID NO:382) displays the β-jelly roll fold typical of GH11 xylanases. Indeed the conformation of GH11 enzymes have been compared with the shape of a right hand with the "fingers" at the top, the "palm" at the bottom and the thumb at the right side of the molecule. The final model of the enzyme contains 1 α-helix and two curved antiparallel β-sheets comprising 6 and 8 β-strands, respectively. A DALI search shows that the three-dimensional structure of SEQ ID NO:382 is most similar to endo-1,4-xylanase II from *Trichoderma reesei* with an RMSD of 0.76 Å and indeed exhibits an RMSD of <1.0 Å for 36 proteins which are all GH11 xylanases.

The concave larger β-sheet of the exemplary enzyme of the invention SEQ ID NO:382 comprises the substrate binding cleft. In the centre of the active site are the two catalytic residues, Glu-89 (catalytic nucleophile) and Glu-181 (catalytic acid-base) on β-strands 9 and 13, respectively. The two glutamates, which are invariant in GH11 enzymes, are separated by ~6 Å, entirely consistent with the catalytic apparatus of "retaining" glycoside hydrolases which hydrolyse glycosidic bonds by a double displacement mechanism. The pH optima of GH11 xylanases are influenced by the amino acid adjacent to the acid/base catalyst. In enzymes that display an acid pH optimum, this residue is aspartic acid, whereas it is asparagine in those that function under more alkaline conditions. In SEQ ID NO:382 the residue adjacent to Glu-181, the catalytic acid-base, is Asn-48, consistent with the alkaline pH optimum displayed by the enzyme. The topology of the substrate binding cleft indicates that the enzyme contains five sugar binding subsites, three glycone (−3 to −1) and two aglycone (+1 and +2) of the site of bond cleavage.

The crystal structure of the exemplary enzyme of the invention SEQ ID NO:482 is extremely similar to the "wild type" enzyme—the exemplary enzyme of the invention SEQ ID NO:382. The amino acid differences between the "wild type" SEQ ID NO:382 and "mutant" xylanase SEQ ID NO:482, which are all in the N-terminal region of the protein, are located on β-strands 2, 3 and 4 and the loops connecting β-strands 1 and 2 and 5 and 6. The mechanisms by which these amino acid changes increase the thermostability of the enzyme are intriguing. The N14H mutations causes the most significant increase in thermostability with a $T_m$ 11° higher than the wild type enzyme and yet the interactions between this amino acid and the equivalent residue in the wild enzyme, Asn-14, are very similar. Thus, the backbone O and N of both residues make hydrogen bonds with the carbonyl and amine, respectively of residue 17. The Nδ2 of Asn-14 in the "wild type" enzyme (SEQ ID NO:382) and the Nε2 of His-14 in SEQ ID NO:482 both make a hydrogen bond with the carbonyl backbone of amino acid 34, while the side chains of the histidine and the asparagine may also make an additional weak interaction with Asn-15, although the geometry of these interactions are suboptimal for ideal hydrogen bonds. The electron cloud of the imidazole ring of His-14 is sandwiched between Asn-15 and Leu-33 and thus will make van der Waals contacts with these two residues, and it is possible that these interactions contribute to overall protein stability. The precise mechanism by which the N14H mutation causes such a substantial increase in thermostability is currently very unclear and points to how extremely subtle changes in protein structure can have a substantial impact on thermal stability. The S9P mutation also results a substantial increase in the $T_m$ (4.6° C.) of the enzyme, however, the molecular basis for this increase in stability is not readily apparent. The proline in the mutant makes weak hydrophobic interactions with the aromatic side chain of Phe-21, however, the Oγ of Ser-9 in the wild type xylanase forms hydrogen bonds with the backbone carbonyl and NH of Lys-23. As residue 9 is in the region connecting βstrands 1 and 2, it is possible that the proline ring may contribute to protein stability by locking the conformation of this loop into an optimum conformation for the overall protein fold of the protein. The phenylalanine introduced in the T13F mutant makes numerous van der Waals contacts with Phe-18, while the hydroxyl of Thr-13 in the wild type enzyme does not make direct hydrogen bonds within the protein. Thus, the increased thermostability displayed by the T13F mutant, compared to the wild type enzyme (SEQ ID NO:382), is the result of hydrophobic interactions between Phe-13 and Phe-18. The increase in stability afforded by the Y18F and Q34L mutations are intriguing. The substitution of the glutamine with leucine results in the loss of three direct hydrogen bonds between the side chain of Gln-34 and the Nϵ2 of Gln-3 and the Oγ of Thr-40 and the backbone carbonyl of Cys-32 within the protein. The loss of these hydrogen bonds may be compensated, to some extent, by van der Waals contacts between Leu-34 and the hydrocarbon chain of Arg-38. It would appear, therefore, that both Tyr-18 and Leu-34 are unlikely to increase thermostability by increasing direct interactions within the protein molecule. It is interesting to note, however, that there are extensive solvent mediated hydrogen bonding networks between Oη of Tyr-18 and Gln-56 and Asn-174, while Oϵ1 of Gln-34 also makes water mediated interactions with Gln-3, Ser-35 and Arg38. It is possible that the loss of two and five water molecules through the Q34L and Y18F mutations, respectively, may increase the entropy associated with protein folding and hence thermostability. The increase in thermostability afforded by the S35E mutation is particularly intriguing. The side chain of the introduced glutamate does not make any interactions with the protein and, indeed it is highly disordered and has been modeled in four different conformations. Although significant stabilization by charged residues at the surface is due to salt-bridge formation, it has been shown that optimum placing of individual charged surface residues in the overall electrostatic network provides a general model for hyperthermophilic protein stability. It remains possible that, since desolvation of charged side-chains is destabilizing, the charge introduction may limit the local conformation, stabilizing the loop connecting β-strands 4 and 5 (Glu-35 is at the very end of β-strand 4) and improving cooperativity. If the disruption of this loop initiates the unfolding process, then the rationale for the dramatic influence of the S35E mutation on protein stability is more evident.

This study demonstrates the powerful methodology of Gene Site Saturation Mutagenesis™ (GSSM™) evolution for designing enzymes (including polypeptides of this invention) with increased stability at a structural level. Intriguingly the majority of the mutations do not mediate interactions typically associated with increased stability, such as the introduction of ion pairs, disulphide bridges, the filling of cavities with hydrophobic residues or increased hydrogen bonding networks within the protein. Remarkably the most thermostabilizing mutation, N14H, which causes an in increase in the $T_m$ of 8° appears to mediate its effect through the introduction of a few van der Waals contacts between the imidazole ring of the histidine and adjacent residues. It is unexpected that these relatively weak interactions would cause such a dramatic increase in stability, while the Y18F mutation appears to have no effect on direct interactions within the protein but may increase stability by disrupting a solvent mediate hydrogen bonding network. The crystallographic structural analysis shows that even in hindsight, the mechanism by which the mutations in SEQ ID NO:482 contribute to the enzyme's thermostability is not clear. This method highlights the power of the non-stochastic approach GSSM method taken here, utilizing both GSSM evolution and high throughput screening.

The biochemical and biophysical properties of the exemplary SEQ ID NO:382 and SEQ ID NO:482 makes these enzymes of the invention attractive for industrial and other uses; they—and all the enzymes of this invention—have many potential applications in several biotechnology-based industries including the animal feed, paper/pulp and the bioenergy sectors.

Example 15

Enzymatic Activity and Characterization of Enzymes of the Invention

This example describes various characteristics of exemplary xylanase enzymes of the invention, including, e.g., enzymatic activity (including activity as determined by sequence identity—or homology—to known enzymes), initial source of the polypeptide and the like, as explained in detail, below.

For example, to help in reading the table immediately below, in the first row, referencing the polypeptide having the sequence of SEQ ID NO:484, encoded e.g., by SEQ ID NO:483, the initial source of this exemplary sequence is unknown, based on sequence homology to known enzymes it can be classified into Family 10 of xylanases, based on sequence homology to known enzymes it has a "predicted" EC number of 3.2.1.8, and has xylanase activity; the in the last column on the right, the results of enzymatic activity on azo-xylan (the assay is described above).

The second table, below are charts describing selected characteristics of exemplary nucleic acids and polypeptides of the invention, including sequence identity comparison of the exemplary sequences to public databases. All sequences described in Tables 2 and 3 (all the exemplary sequences of the invention) have been subject to a BLAST search (as described in detail, below) against two sets of databases. The first database set is available through NCBI (National Center for Biotechnology Information). All results from searches against these databases are found in the columns entitled "NR Description", "NR Accession Code", "NR Evalue" or "NR Organism". "NR" refers to the Non-Redundant nucleotide database maintained by NCBI. This database is a composite of GenBank, GenBank updates, and EMBL updates. The entries in the column "NR Description" refer to the definition line in any given NCBI record, which includes a description of the sequence, such as the source organism, gene name/protein name, or some description of the function of the sequence. The entries in the column "NR Accession Code" refer to the unique identifier given to a sequence record. The entries in the column "NR Evalue" refer to the Expect value (Evalue), which represents the probability that an alignment score as good as the one found between the query sequence (the sequences of the invention) and a database sequence would be found in the same number of comparisons between random sequences as was done in the present BLAST search. The entries in the column "NR Organism" refer to the source organism of the sequence identified as the closest BLAST hit. The second set of databases is collectively known as the GENESEQ™ database, which is available through Thomson Derwent (Philadelphia, Pa.). All results from searches against this database are found in the columns entitled "GENESEQ™ Protein Description", "GENESEQ™ Protein Accession Code", "GENESEQ™ Protein Evalue", "GENESEQ™ DNA Description", "GENESEQ™ DNA Accession Code" or "GENESEQ™ DNA Evalue" The information found in these columns is comparable to the information found in the NR columns described above, except that it was derived from BLAST searches against the GENESEQ™ database instead of the NCBI databases. In addition, this table includes the column "Predicted EC No.". An EC number is the number assigned to a type of enzyme according to a scheme of standardized enzyme nomenclature developed by the Enzyme Commission of the Nomenclature Committee of the International Union of Biochemistry and Molecular Biology (IUBMB). The results in the "Predicted EC No." column are determined by a BLAST search against the Kegg (Kyoto Encyclopedia of Genes and Genomes) database. If the top BLAST match has an Evalue equal to or less than $e^{-6}$, the EC number assigned to the top match is entered into the table. The EC number of the top hit is used as a guide to what the EC number of the sequence of the invention might be. The columns "Query DNA Length" and "Query Protein Length" refer to the number of nucleotides or the number amino acids, respectively, in the sequence of the invention that was searched or queried against either the NCBI or GENESEQ™ databases. The columns "GENESEQ™ or NR DNA Length" and "GENESEQ™ or NR Protein Length" refer to the number of nucleotides or the number amino acids, respectively, in the sequence of the top match from the BLAST search. The results provided in these columns are from the search that returned the lower Evalue, either from the NCBI databases or the Geneseq database. The columns "GENESEQ™ or NR % ID Protein" and "GENESEQ™ or NR % ID DNA" refer to the percent sequence identity between the sequence of the invention and the sequence of the top BLAST match. The results provided in these columns are from the search that returned the lower Evalue, either from the NCBI databases or the GENESEQ™ database.

| SEQ ID NO: | Source | FAMILY | Predicted EC Number | Activity Class | Enzymatic Activity on Azo-Xylan |
|---|---|---|---|---|---|
| 483, 484 | Unknown | 10 | 3.2.1.8 | Xylanase | none observed under conditions tested |
| 485, 486 | Unknown | 10 | 3.2.1.8 | Xylanase | ++ |
| 487, 488 | Unknown | 10 | 3.2.1.8 | Xylanase | low |
| 489, 490 | Unknown | 10 | 3.2.1.8 | Xylanase | low |
| 491, 492 | Unknown | 10 | 3.2.1.8 | Xylanase | |
| 493, 494 | Unknown | 10 | | Xylanase | + |
| 495, 496 | Unknown | 11 | 3.2.1.8 | Xylanase | some |
| 497, 498 | Unknown | 10 | 3.2.1.8 | Xylanase | some |
| 499, 500 | Unknown | 11 | 3.2.1.8 | Xylanase | + |
| 501, 502 | Unknown | 11 | 3.2.1.8 | Xylanase | + |
| 503, 504 | Unknown | 11 | 3.2.1.8 | Xylanase | some |
| 505, 506 | Unknown | 11 | 3.2.1.8 | Xylanase | some |
| 507, 508 | Unknown | 10 | 3.2.1.8 | Xylanase | none observed under conditions tested |
| 509, 510 | Unknown | 11 | 3.2.1.8 | Xylanase | + |
| 511, 512 | Unknown | 11 | 3.2.1.8 | Xylanase | some |
| 513, 514 | Unknown | 11 | 3.2.1.8 | Xylanase | some |
| 515, 516 | Unknown | 10 | 3.2.1.8 | Xylanase | + |
| 517, 518 | Unknown | 11 | 3.2.1.8 | Xylanase | + |
| 519, 520 | Unknown | 11 | 3.2.1.8 | Xylanase | some |
| 521, 522 | Unknown | 10 | 3.2.1.8 | Xylanase | none observed under conditions tested |
| 523, 524 | Unknown | 10 and 43 | 3.2.1.8 | Xylanase | none observed under conditions tested |
| 525, 526 | Unknown | 10 | 3.2.1.8 | Xylanase | + |
| 527, 528 | Unknown | 11 | 3.2.1.8 | Xylanase | |
| 529, 530 | Unknown | 11 | 3.2.1.8 | Xylanase | |
| 531, 532 | Unknown | 11 | 3.2.1.8 | Xylanase | |
| 533, 534 | Unknown | 10 | 3.2.1.8 | Xylanase | |
| 535, 536 | Unknown | 10 | 3.2.1.8 | Xylanase | some |
| 537, 538 | Unknown | 10 | 3.2.1.8 | Xylanase | ++ |
| 539, 540 | Unknown | 11 | 3.2.1.8 | Xylanase | some |
| 541, 542 | Unknown | 11 | 3.2.1.8 | Xylanase | + |
| 543, 544 | Unknown | 10 | 3.2.1.8 | Xylanase | |
| 545, 546 | Unknown | 10 | 3.2.1.8 | Xylanase | |
| 547, 548 | Unknown | 11 | 3.2.1.8 | Xylanase | |
| 549, 550 | Unknown | 10 | 3.2.1.8 | Xylanase | |
| 551, 552 | Unknown | 10 | 3.2.1.8 | Xylanase | |
| 553, 554 | Unknown | 11 | 3.2.1.8 | Xylanase | |
| 555, 556 | Unknown | 11 | 3.2.1.8 | Xylanase | |
| 557, 558 | Unknown | 11 | 3.2.1.8 | Xylanase | |
| 559, 560 | Unknown | 10 | 3.2.1.8 | Xylanase | |
| 561, 562 | Unknown | 10 | 3.2.1.8 | Xylanase | |
| 563, 564 | Unknown | 8 | | Xylanase/Glucanase | |
| 565, 566 | Unknown | 10 | 3.2.1.8 | Xylanase | |
| 567, 568 | Unknown | 10 | 3.2.1.8 | Xylanase | |
| 569, 570 | Unknown | 30 | | Xylanase | |
| 571, 572 | Unknown | 10 | 3.2.1.8 | Xylanase | |
| 573, 574 | Unknown | 10 | 3.2.1.8 | Xylanase | |
| 575, 576 | Unknown | 10 | 3.2.1.8 | Xylanase | |
| 577, 578 | Unknown | 11 | 3.2.1.8 | Xylanase | |
| 579, 580 | Unknown | 10 | 3.2.1.8 | Xylanase | |

| SEQ ID NO: | NR Description | | NR Accession Code | NR Evalue | NR Organism | | Geneseq Protein Description | Geneseq Protein Accession Code | Geneseq Protein Evalue | Geneseq DNA Description |
|---|---|---|---|---|---|---|---|---|---|---|
| 581, 582 | | Unknown | | | | 3.2.1.8 | Xylanase | | | |
| 583, 584 | | Unknown | | | | 3.2.1.8 | Xylanase | | | |
| 585, 586 | | Unknown | | | | 3.2.1.8 | Xylanase | | | |
| 587, 588 | | Unknown | | | | 3.2.1.8 | Xylanase | | | |
| 589, 590 | | Unknown | | | | 3.2.1.8 | Xylanase | | | |
| 591, 592 | | Unknown | | | | 3.2.1.8 | Xylanase | | | |
| 593, 594 | | Unknown | | | | 3.2.1.8 | Xylanase | | | |
| 595, 596 | | Unknown | | | | 3.2.1.8 | Xylanase | | | |
| 597, 598 | | Unknown | | | | 3.2.1.8 | Xylanase | | | |
| 599, 600 | | Unknown | | | | 3.2.1.8 | Xylanase | | | |
| 601, 602 | | Unknown | | | | 3.2.1.8 | Xylanase | | | |
| 603, 604 | | Unknown | | | | 3.2.1.8 | Xylanase | | | |
| 605, 606 | | Unknown | | | | 3.2.1.8 | Xylanase | | | |
| 607, 608 | | Unknown | | | | 3.2.1.8 | Xylanase | | | |
| 609, 610 | | Unknown | | | | 3.2.1.8 | Xylanase | | | |
| 611, 612 | | Unknown | | | | 3.2.1.8 | Xylanase | | | |
| 613, 614 | | Unknown | | | | 3.2.1.8 | Xylanase | | | |
| 615, 616 | | Unknown | | | | 3.2.1.8 | Xylanase | | | |
| 617, 618 | | Unknown | | | | 3.2.1.8 | Xylanase | | | |
| 619, 620 | | Unknown | | | | 3.2.1.8 | Xylanase | | | |
| 621, 622 | | Unknown | | | | 3.2.1.8 | Xylanase | | | |
| 623, 624 | | Unknown | | | | 3.2.1.8 | Xylanase | | | |
| 625, 626 | | Unknown | | | | 3.2.1.8 | Xylanase | | | |
| 627, 628 | | Unknown | | | | 3.2.1.8 | Xylanase | | | |
| 629, 630 | | Unknown | | | | 3.2.1.8 | Xylanase | | | |
| 631, 632 | | Unknown | | | | 3.2.1.8 | Xylanase | | | |
| 633, 634 | | Unknown | | | | 8 | Xylanase | | | |
| 635, 636 | | Unknown | | | | 3.2.1.8 | Xylanase | | | |
| 385, 386 | family F xylanase [*Fusarium oxysporum f.* sp. *lycopersici*]. | | 21244241 | 1.00E-105 | *Xanthomonas axonopodis* pv. *citri* str. 306 | | DNA encoding novel human diagnostic protein #20574. | ABG24489 | 2.00E-54 | *S. spinosa* protein fragment encoded by ORF24, SEQ ID 55. |
| 387, 388 | xylanase T-6 [*Geobacillus stearothermophilus*] | | 498820 | 0 | *Geobacillus stearothermophilus* | | Thermostable alkaline endo-1,4-beta-D-Xylanase. | AAR76550 | 1.00E-135 | Thermostable alkaline endo-1,4-beta-D-Xylanase. |
| 389, 390 | endoglucanase [*Erwinia rhapontici*]. | | 7688166 | 1.00E-136 | *Erwinia rhapontici* | | Cellulase gene. | AAP70396 | 9.00E-97 | Cellulase gene. |
| 391, 392 | probable endoglucanase precursor [*Salmonella enterica* subsp. *enterica* serovar Paratyphi A str. ATCC 9150] | | 56129776 | 1.00E-175 | *Salmonella enterica* subsp. *enterica* serovar Paratyphi A str. ATCC 9150 | | DNA encoding novel human diagnostic protein #20574. | ABG24489 | 1.00E-130 | DNA encoding novel human diagnostic protein #20574. |
| 393, | unnamed protein product | | 39416 | 6.00E-85 | *Bacillus circulans* | | Protein of a | AAO20964 | 3.00E-82 | Coding sequence |

| | | | | | |
|---|---|---|---|---|---|
| 394 | [Bacillus circulans] | 15823752 | 0 | AAO20964 | SEQ ID 229, differentially expressed in osteogenesis. Protein of a Bacillus species alkaline cellulase. |
| 395, 396 | endoglucanase-N257 [Bacillus circulans]. | 15642836 | 1.00E-79 | AAW14319 | Xylanase A. |
| 397, 398 | endo-1,4-beta-xylanase A [Thermotoga maritima] | 25989577 | 1.00E-173 | AAW48290 | Thermotoga neopolitana endo-xylanase enzymes. |
| 399, 400 | alpha-L-arabinofuranosidase ArfA [Clostridium cellulovorans]. | 498820 | 1.00E-168 | AAR76550 | B. subtilis arabinase coding sequence. |
| 401, 402 | xylanase T-6 [Geobacillus stearothermophilus] | 450852 | 1.00E-100 | AAW93151 | Thermostable alkaline endo-1,4-beta-D-xylanase. |
| 403, 404 | xylanase precursor [Bacteroides ovatus] | 18476191 | 2.00E-66 | AAW93150 | Xylanase gene fragment obtained by soil DNA amplification. |
| 405, 406 | beta-1,4-xylanase [uncultured bacterium] | 16127035 | 1.00E-96 | AAY81494 | Xylanase gene fragment obtained by soil DNA amplification. |
| 407, 408 | glycosyl hydrolase, family 10 [Caulobacter crescentus]. | 1722897 | 5.00E-94 | AAU96951 | Arabidopsis thaliana protein fragment SEQ ID NO: 76191. |
| 409, 410 | ENDO-1,4-BETA-XYLANASE PRECURSOR (XYLANASE I) (1,4-BETA-D-XYLAN XYLANOHYDROLASE I). | 455907 | 1.00E-118 | AAW67567 | Sequence of pre-pro lipase. |
| 411, 412 | endoxylanase II; pl 9 [Hypocrea jecorina] | 48860434 | 3.00E-55 | AAR20472 | 3' primer to clone T. reesei xln1 gene in expression vector. |
| 413, 414 | COG3405: Endoglucanase Y [Clostridium thermocellum ATCC 27405] | 56129776 | 1.00E-166 | ABG24489 | Thermomonospora fusca cellulase E2 gene. |
| 415, | probable endoglucanase | | | | DNA encoding |

| SEQ ID | Description | Organism | Description 2 | Accession | E-value | Description 3 |
|---|---|---|---|---|---|---|
| 416 | precursor [Salmonella enterica subsp. enterica serovar Paratypi A str. ATCC 9150] | subsp. enterica serovar Paratypi A str. ATCC 9150 | novel human diagnostic protein #20574. | | | novel human diagnostic protein #20574. |
| 417, 418 | Endoglucanase precursor [Escherichia coli CFT073] gi|26110594|gb|AAN82779.1| Endoglucanase precursor [Escherichia coli CFT073] | Escherichia coli CFT073 | DNA encoding novel human diagnostic protein #20574. | ABG24489 | 1.00E-161 | DNA encoding novel human diagnostic protein #20574. |
| 419, 420 | I40696|endoglucanase - Cellulomonas uda | | Cellulase gene. | AAP70396 | 1.00E-120 | Cellulase gene. |
| 421, 422 | xylanase III [Hypocrea jecorina]. | Hypocrea jecorina | PCR primer X18 for DNA encoding a heat stable xylanase polypeptide. | AAY93607 | 1.00E-109 | Aspergillus oryzae polynucleotide SEQ ID NO 3150. |
| 423, 424 | COG3405: Endoglucanase Y [Ralstonia eutropha JMP134] | Ralstonia eutropha JMP134 | DNA encoding novel human diagnostic protein #20574. | ABG24489 | 1.00E-55 | Mycobacterium leprae embB-encoded peptide Lpembb. |
| 425, 426 | putative beta-1,4-xylanase [Streptomyces avermitilis MA-4680] | Streptomyces avermitilis MA-4680 | Xylanase gene fragment obtained by soil DNA amplification. | AAW09777 | 1.00E-38 | Soybean 240O17 region G3 DNA reverse primer, SEQ ID NO: 416. |
| 427, 428 | 1IN82|B The High-Resolution Crystal Structure Of Ixt6; A Thermophilic; Intracellular Xylanase From G. Stearothermophilus | | Streptomyces sp. Bgal gene RBS RNA fragment. | AAW93149 | 6.00E-99 | Thermostable alkaline endo-1,4-beta-D-xylanase. |
| 429, 430 | putative endoglucanase [Escherichia coli O157:H7 EDL933]. | Escherichia coli O157:H7 EDL933 | DNA encoding novel human diagnostic protein #20574. | ABG24489 | 1.00E-162 | DNA encoding novel human diagnostic protein #20574. |
| 431, 432 | ENDO-1,4-BETA-XYLANASE PRECURSOR (XYLANASE) (1,4-BETA-D-XYLAN XYLANOHYDROLASE) (FIA-XYLANASE). | Aspergillus aculeatus | Aspergillus niger arabinoxylan degrading enzyme. | AAW14598 | 1.00E-172 | Aspergillus aculeatus xylanase II. |
| 433, 434 | xylanase I [Streptomyces thermoviolaceus] | Streptomyces thermoviolaceus | Streptomyces sp. Bgal gene RBS RNA fragment. | AAW93158 | 1.00E-119 | Streptomyces olivaceoviridis xylanase. |
| 435, 436 | family F xylanase [Fusarium oxysporum f. sp. lycopersici]. | Fusarium oxysporum f. sp. lycopersici | C. minitans novel xylanase Cxy1. | AAB29041 | 0 | Partial Chrysosporium GPD1. |
| 437, 438 | I40696|endoglucanase - Cellulomonas uda | | Cellulase gene. | AAP70396 | 1.00E-116 | celY and celZ integration vector, pLOI2352. |
| 439, | intra-cellular xylanase | Geobacillus | Streptomyces | AAW93149 | 3.00E-94 | T. thermophila |

| # | Description | Organism | Match description | Accession | E-value | Notes |
|---|---|---|---|---|---|---|
| 440 | [Bacillus stearothermophilus]. | stearothermophilus | sp. Bgal gene RBS RNA fragment. | AAE16323 | 4.00E-16 | delta-6-desaturase protein fragment SEQ ID 5. |
| 441, 442 | ORF_ID: tlr1902-probable endo-1,4-beta-xylanase [Thermosynechococcus elongatus BP-1]. | Thermosynechococcus elongatus BP-1 | TokelR primer used to isolate Tok7B.1 celE gene. | | 1.00E-25 | Drosophila melanogaster polypeptide SEQ ID NO 24465. |
| 443, 444 | COG3693: Beta-1,4-xylanase [Microbulbifer degradans 2-40] | Microbulbifer degradans 2-40 | Vibrio harveyi endoglucanase DNA. | AAW34988 | 1.00E-169 | Vibrio harveyi endoglucanase DNA. |
| | | | | | 1.00E-112 | |
| 445, 446 | intra-cellular xylanase [uncultured bacterium] | uncultured bacterium | TokelR primer used to isolate Tok7B.1 celE gene. | AAE16323 | 3.00E-70 | FLO11 gene expression regulator An17 coding sequence. |
| | | | | | 2.00E-77 | |
| 447, 448 | putative endoglucanase [Escherichia coli O157: H7 EDL933]. | Escherichia coli O157: H7 EDL933 | DNA encoding novel human diagnostic protein #20574. | ABG24489 | 1.00E-117 | DNA encoding novel human diagnostic protein #20574. |
| | | | | | 1.00E-162 | |
| 449, 450 | endo-1,4-D-glucanase [Salmonella typhimurium LT2]. | Salmonella typhimurium LT2 | DNA encoding novel human diagnostic protein #20574. | ABG24489 | 1.00E-123 | DNA encoding novel human diagnostic protein #20574. |
| | | | | | 1.00E-166 | |
| 451, 452 | I39760|endo-1,4-beta-xylanase (EC 3.2.1.8) - Bacillus stearothermophilus | | Streptomyces sp. Bgal gene RBS RNA fragment. | AAW93149 | 7.00E-69 | Mouse Beta2 integrin alphaD subunit sequencing primer #19. |
| | | | | | 1.00E-103 | |
| 453, 454 | hypothetical protein FG06445.1 [Gibberella zeae PH-1] | Gibberella zeae PH-1 | PCR primer, 12207, used to amplify expression casssette within A. niger. | AAU99346 | 3.00E-80 | Myceliophthora thermophila xylanase cDNA. |
| | | | | | 1.00E-108 | |
| 455, 456 | COG3693: Beta-1,4-xylanase [Clostridium thermocellum ATCC 27405] | Clostridium thermocellum ATCC 27405 | Clostridium stercorarium xylanase A DNA. | AAY70518 | 0 | Clostridium stercorarium xylanase A DNA. |
| | | | | | 0 | |
| 457, 458 | probable endoglucanase precursor [Salmonella enterica subsp. enterica serovar Paratypi A str. ATCC 9150] | Salmonella enterica subsp. enterica serovar Paratypi A str. ATCC 9150 | DNA encoding novel human diagnostic protein #20574. | ABG24489 | 1.00E-119 | DNA encoding novel human diagnostic protein #20574. |
| | | | | | 1.00E-151 | |
| 459, 460 | endoxylanase [Alternaria alternata]. | Alternaria alternata | C. mititans novel xylanase Cxy1. | AAB29041 | 6.00E-97 | Aspergillus aculeatus xylanase II. |
| | | | | | 1.00E-141 | |
| 461, 462 | endo-1,4-beta-D-glucanase precursor [Pectobacterium chrysanthemi]. | Pectobacterium chrysanthemi | Cellulase gene. | AAP70396 | 1.00E-111 | Cellulase gene. |
| | | | | | 1.00E-114 | |
| 463, | |1N82|B The High-Resolution | | Streptomyces | AAW93149 | 1.00E-97 | Xylanase gene |
| | | | | | 1.00E-125 | |

| SEQ ID NO: | NR Description | NR Accession Code | NR Evalue | NR Organism | Geneseq Protein Description | Geneseq Protein Accession Code | Geneseq Protein Evalue | Geneseq DNA Description | Geneseq DNA Accession Code |
|---|---|---|---|---|---|---|---|---|---|
| 464 | Crystal Structure Of Ixt6; A Thermophilic; Intracellular Xylanase From G. Stearothermophilus | | | | | | | | |
| 465, 466 | xylanase [Thermotoga neopolitana] | 603892 | 0 | Thermotoga neopolitana | Thermotoga neopolitana endo-xylanase enzymes. | AAW14319 | 0 | fragment obtained by soil DNA amplification. Thermotoga neopolitana endo-xylanase enzymes. | |
| 467, 468 | endoglucanase fragment [Aquifex aeolicus]. | 15606586 | 0 | Aquifex aeolicus | Gene encoding cellulose synthetase complex amplifying primer 1. | AAW69760 | 9.00E-22 | Human immune system associated gene SEQ ID NO: 59. | |
| 469, 470 | COG3693: Beta-1,4-xylanase [Clostridium thermocellum ATCC 27405] | 48860196 | 1.00E-130 | Clostridium thermocellum ATCC 27405 | Herbicidally active polypeptide SEQ ID NO 2. | ABB91388 | 1.00E-76 | Neisseria meningitidis ORF 529 protein sequence SEQ ID NO: 1522. | |
| 471, 472 | xylanase precursor [Bacteroides ovatus] | 450852 | 1.00E-73 | Bacteroides ovatus | Xylanase A. | AAR87013 | 3.00E-64 | Xylanase gene fragment obtained by soil DNA amplification. | |
| 473, 474 | intra-cellular xylanase [uncultured bacterium] | 31580723 | 5.00E-60 | uncultured bacterium | Streptomyces sp. Bgal gene RBS RNA fragment. | AAW93149 | 1.00E-54 | Drosophila melanogaster polypeptide SEQ ID NO 24465. | |
| 475, 476 | endo-1,4-beta-xylanase [Thermobacillus xylanilyticus]. | 2980618 | 1.00E-64 | Thermobacillus xylanilyticus | Xylanase A. | AAR87013 | 6.00E-57 | Streptomyces olivaceoviridis xylanase. | |
| 447, 478 | chitosanase-glucanase [Bacillus sp. D-2]. | 15552945 | 1.00E-123 | Bacillus sp. D-2 | Protein of a Bacillus species alkaline cellulase. | AAO20964 | 5.00E-84 | Fusarium venenatum EST SEQ ID NO: 1176. | |
| 479, 480 | xylanase [Aspergillus niger] | 44238731 | 9.00E-89 | Aspergillus niger | PCR primer PGP02 for amplifying Yeast PGK promoter. | AAR22039 | 7.00E-89 | Glutelin gene PCR primer sequence 3'GtI.4. | |
| 483, 484 | family 10 xylanase [Caldicellulosiruptor sp. Rt69B.1] | 2760908 | 0 | Caldicellulosiruptor sp. Rt69B.1 | Xylanase from an environmental sample seq id 14. | ADJ34904 | 0 | Xylanase from an environmental sample seq id 14. | ADJ34903 |

| | | | | | |
|---|---|---|---|---|---|
| 485, 486 | Xylanase, glycosyl hydrolase family 10 [*Clostridium acetobutylicum*]. | 15004819 | 5.00E-75 | *Clostridium acetobutylicum* | Xylanase from an environmental sample seq id 14. | ADJ34864 | 1.00E-78 | Human enzyme protein encoding gene. | AAD48289 |
| 487, 488 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 3.00E-88 | *Solibacter usitatus* Ellin6076 | Xylanase from an environmental sample seq id 14. | ADJ35142 | 1.00E-93 | Xylanase from an environmental sample seq id 14. | ADJ34915 |
| 489, 490 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 1.00E-115 | *Solibacter usitatus* Ellin6076 | Xylanase from an environmental sample seq id 14. | ADJ35142 | 1.00E-132 | Xylanase from an environmental sample seq id 14. | ADJ34881 |
| 491, 492 | Methionine biosynthesis MetW [*Saccharophagus degradans* 2-40] | 90023252 | 0 | *Saccharophagus degradans* 2-40 | *Microbulbifer degradans* cellulase system protein - SEQ ID 8. | AEH81891 | 0 | *Microbulbifer degradans* cellulase system protein - SEQ ID 8. | AEH81892 |
| 493, 494 | Glycoside hydrolase, family 10: *Clostridium* cellulosome enzyme, dockerin type I: Carbohydrate-binding, CenC-like [*Clostridium thermocellum* ATCC 27405] gi|67851540|gb|EAM47104.1| Glycoside hydrolase, family 10: *Clostridium* cellulosome enzyme, dockerin type I: | 67873837 | 5.00E-33 | *Clostridium thermocellum* ATCC 27405 | Xylanase from an environmental sample seq id 14. | ADJ34854 | 4.00E-32 | *Propionibacterium acnes* immunogenic protein #28612. | AAS59544 |
| 495, 496 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 1.00E-112 | *Solibacter usitatus* Ellin6076 | Xylanase from an environmental sample seq id 14. | ADJ34920 | 1.00E-141 | Xylanase from an environmental sample seq id 14. | ADJ34881 |
| 497, 498 | endo-1,4-beta-xylanase precursor [uncultured bacterium] | 46253616 | 1.00E-107 | uncultured bacterium | Xylanase from an environmental sample seq id 14. | ADJ34978 | 1.00E-108 | Xylanase from an environmental sample seq id 14. | ADJ34963 |

| | | | | | | |
|---|---|---|---|---|---|---|
| 499, 500 | Endo-1,4-beta-xylanase [Solibacter usitatus Ellin6076] gi|116224961|gb|ABJ83670.1| Endo-1,4-beta-xylanase [Solibacter usitatus Ellin6076] | 1.17E+08 | 1.00E-122 | Solibacter usitatus Ellin6076 | Xylanase from an environmental sample seq id 14. | ADJ35142 | 1.00E-122 | ADJ35141 |
| 501, 502 | endo-1,4-beta-xylanase XynI [Cellulomonas flavigena] | 1.1E+08 | 4.00E-79 | Cellulomonas flavigena | Xylanase from an environmental sample seq id 14. | ADJ34996 | 1.00E-112 | ADJ34995 |
| 503, 504 | endo-beta-1,4-xylanase [Cellvibrio mixtus] | 757807 | 1.00E-100 | Cellvibrio mixtus | Xylanase from an environmental sample seq id 14. | ADJ34976 | 1.00E-107 | AAA07246 |
| 505, 506 | xylanase/chitin deacetylase-like [Saccharophagus degradans 2-40] | 90022703 | 1.00E-104 | Saccharophagus degradans 2-40 | Xylanase from an environmental sample seq id 14. | ADJ34990 | 1.00E-171 | ADJ34989 |
| 507, 508 | xylanase/chitin deacetylase-like [Saccharophagus degradans 2-40] | 90022703 | 1.00E-106 | Saccharophagus degradans 2-40 | Xylanase from an environmental sample seq id 14. | ADJ34996 | 0 | ADJ34989 |
| 509, 510 | Carbohydrate binding family 6 [Clostridium cellulolyticum H10] gi|118663312|gb|EAV69968.1| Carbohydrate binding family 6 [Clostridium cellulolyticum H10] | 1.19E+08 | 2.00E-79 | Clostridium cellulolyticum H10 | Xylanase from an environmental sample seq id 14. | ADJ34872 | 1.00E-69 | ABD32815 |
| 511, 512 | beta-1,4-xylanase [Pseudomonas sp. ND137]. | 17826947 | 1.00E-106 | Pseudomonas sp. ND137 | Xylanase from an environmental sample seq id 14. | ADJ35152 | 1.00E-148 | ADJ34989 |
| 513, 514 | endo-1,4-beta-xylanase [Bacillus sp. YA-335] | 1334251 | 1.00E-147 | Bacillus sp. YA-335 | Xylanase from an environmental sample seq id 14. | ADJ34948 | 1.00E-147 | AAQ92878 |
| 515, 516 | alkaline active endoxylanase precursor [Bacillus halodurans] | 56567273 | 0 | Bacillus halodurans | Bacterial polypeptide #10001. | ADS28252 | 0 | AAQ92862 |
| 517, 518 | xylanase/chitin deacetylase-like [Saccharophagus degradans 2-40] | 90022703 | 1.00E-132 | Saccharophagus degradans 2-40 | Xylanase from an environmental sample seq id 14. | ADJ35046 | 0 | ADJ35045 |

| | | | | | | |
|---|---|---|---|---|---|---|
| 519, 520 | xylanase/chitin deacetylase-like [Saccharophagus degradans 2-40] | 90022703 | 1.00E-132 | Saccharophagus degradans 2-40 | Xylanase from an environmental sample seq id 14. | ADJ35046 | 0 | Xylanase from an environmental sample seq id 14. | ADJ34995 |
| 521, 522 | xylanase [uncultured organism] | 57639627 | 1.00E-142 | uncultured organism | Xylanase from an environmental sample seq id 14. | ADJ35110 | 0 | Xylanase from an environmental sample seq id 14. | ADJ35109 |
| 523, 524 | endo-beta-1,4-xylanase [Cellvibrio mixtus] | 757807 | 3.00E-59 | Cellvibrio mixtus | Xylanase from an environmental sample seq id 14. | ADJ34998 | 4.00E-60 | Human immune/haematopoietic antigen genomic sequence SEQ ID NO: 41436. | AAK72613 |
| 525, 526 | Methionine biosynthesis MetW [Saccharophagus degradans 2-40] | 90023252 | 0 | Saccharophagus degradans 2-40 | Microbulbifer degradans cellulase system protein - SEQ ID 8. | AEH81891 | 0 | Microbulbifer degradans cellulase system protein - SEQ ID 8. | AEH81884 |
| 527, 528 | xylanase [uncultured organism] | 57639627 | 1.00E-117 | uncultured organism | Xylanase from an environmental sample seq id 14. | ADJ34932 | 1.00E-132 | Bacterial polypeptide #10001. | ADS63654 |
| 529, 530 | xylanase [uncultured bacterium] | 1.19E+8 | 5.00E-80 | uncultured bacterium | Xylanase from an environmental sample seq id 14. | ADJ34952 | 6.00E-98 | Xylanase from an environmental sample seq id 14. | ADJ34995 |
| 531, 532 | endo-beta-1,4-xylanase [Cellvibrio mixtus] | 757807 | 2.00E-59 | Cellvibrio mixtus | Xylanase from an environmental sample seq id 14. | ADJ34976 | 2.00E-58 | Oligonucleotide SEQ ID NO: 62. | AAA05701 |
| 533, 534 | Methionine biosynthesis MetW [Saccharophagus degradans 2-40] | 90023252 | 1.00E-170 | Saccharophagus degradans 2-40 | Microbulbifer degradans cellulase system protein - SEQ ID 8. | AEH81891 | 1.00E-171 | Microbulbifer degradans cellulase system protein - SEQ ID 8. | AEH81884 |
| 535, 536 | endo-beta-1,4-xylanase [Bacillus sp.] | 662884 | 1.00E-133 | Bacillus sp. | Xylanase from an environmental sample seq id 14. | ADJ34918 | 1.00E-136 | Xylanase from an environmental sample seq id 14. | ADJ34827 |
| 537, 538 | Endo-1,4-beta-xylanase [Saccharophagus degradans 2-40] | 90022278 | 1.00E-125 | Saccharophagus degradans 2-40 | Xylanase from an environmental sample seq id 14. | ADJ34932 | 1.00E-135 | Xylanase from an environmental sample seq id 14. | ADJ35109 |

| SEQ IDs | Name | GI Number | E-value | Organism | Accession | E-value | Description | Accession |
|---|---|---|---|---|---|---|---|---|
| 539, 540 | endo-1:4-beta-xylanase [*Thermobifida fusca* YX] | 72161617 | 5.00E-96 | *Thermobifida fusca* YX | AAR73967 | 1.00E-96 | *T. fusca* xylanase. | AAQ90388 |
| 541, 542 | xylanase X [*Paenibacillus* sp. BL11] | 82491944 | 1.00E-102 | *Paenibacillus* sp. BL11 | ADJ34948 | 1.00E-104 | Thermostable alkaline endo-1,4-beta-D-xylanase. | AAQ92877 |
| 543, 544 | intra-cellular xylanase [uncultured bacterium] | 31580723 | 1.00E-128 | uncultured bacterium | ADJ34846 | 1.00E-137 | Xylanase from an environmental sample seq id 14. | ADJ34877 |
| 545, 546 | ENDO-1,4-BETA-XYLANASE A PRECURSOR (XYLANASE A) (1,4-BETA-D-XYLAN XYLANOHYDROLASE A). | 1722904 | 1.00E-120 | *Bacteroides ovatus* | ADJ35118 | 1.00E-152 | Xylanase from an environmental sample seq id 14. | ADJ34905 |
| 547, 548 | xylanase [uncultured organism] | 57639627 | 1.00E-112 | uncultured organism | ADJ34932 | 1.00E-123 | Xylanase from an environmental sample seq id 14. | ADJ34931 |
| 549, 550 | endo-beta-1,4-xylanase [*Bacillus* sp.] | 662884 | 1.00E-120 | *Bacillus* sp. | ADJ34918 | 1.00E-122 | Xylanase from an environmental sample seq id 14. | ADJ35095 |
| 551, 552 | ENDO-1,4-BETA-XYLANASE A PRECURSOR (XYLANASE A) (1,4-BETA-D-XYLAN XYLANOHYDROLASE A) (XYLA). | 2506385 | 1.00E-107 | *Pseudomonas fluorescens* | ADJ35136 | 0 | Xylanase from an environmental sample seq id 14. | ADJ35135 |
| 553, 554 | endo-1:4-beta-xylanase precursor [uncultured bacterium] | 46253618 | 1.00E-83 | uncultured bacterium | ADJ35054 | 1.00E-140 | Xylanase from an environmental sample seq id 14. | ADJ35053 |
| 555, 556 | xylanase [*Microbulbifer hydrolyticus*] | 50727108 | 1.00E-108 | *Microbulbifer hydrolyticus* | ADJ35152 | 1.00E-150 | Xylanase from an environmental sample seq id 14. | ADJ34989 |
| 557, 558 | xylanase/chitin deacetylase-like [*Saccharophagus degradans* 2-40] | 90022703 | 1.00E-103 | *Saccharophagus degradans* 2-40 | ADJ34996 | 1.00E-169 | Xylanase from an environmental sample seq id 14. | ADJ34995 |
| 559, 560 | endo-beta-1,4-xylanase [*Bacillus* sp.] | 662884 | 1.00E-115 | *Bacillus* sp. | ADJ34878 | 1.00E-119 | Xylanase from an environmental sample seq id 14. | ADJ34845 |

| | | | | | |
|---|---|---|---|---|---|
| 561, 562 | ENDO-1,4-BETA-XYLANASE A PRECURSOR (XYLANASE A) (1,4-BETA-D-XYLAN XYLANOHYDROLASE A) (XYLA). | 2506385 | 1.00E−107 | *Pseudomonas fluorescens* | Xylanase from an environmental sample seq id 14. | ADJ35136 | 0 | Xylanase from an environmental sample seq id 14. | ADJ35135 |
| 563, 564 | CHU large protein; candidate b-glycosidase; glycoside hydrolase family 8 protein [*Cytophaga hutchinsonii* ATCC 33406] | 1.11E+08 | 1.00E−53 | *Cytophaga hutchinsonii* ATCC 33406 | Bacterial polypeptide #10001. | ADS21231 | 2.00E−53 | Human soft tissue sarcoma-upregulated protein - SEQ ID 40. | ADQ21453 |
| 565, 566 | Methionine biosynthesis MetW [*Saccharophagus degradans* 2-40] | 90023252 | 0 | *Saccharophagus degradans* 2-40 | *Microbulbifer degradans* cellulase system protein - SEQ ID 8. | AEH81891 | 0 | Xylanase XYNB. | AAT07200 |
| 567, 568 | xylanase [uncultured organism] | 57639627 | 1.00E−140 | uncultured organism | Xylanase from an environmental sample seq id 14. | ADJ35110 | 0 | Xylanase from an environmental sample seq id 14. | ADJ35109 |
| 569, 570 | Possible xylan degradation enzyme (glycosyl hydrolase family 30-like domain and Ricin B-like domain) [*Clostridium acetobutylicum*]. | 15004822 | 6.00E−40 | *Clostridium acetobutylicum* | Xylanase from an environmental sample seq id 14. | ADJ35028 | 8.00E−27 | *Ciona intestinalis* nervous system associated protein Seq ID 62. | ADQ08627 |
| 571, 572 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 1.00E−123 | *Solibacter usitatus* Ellin6076 | Xylanase from an environmental sample seq id 14. | ADJ35142 | 1.00E−165 | Xylanase from an environmental sample seq id 14. | ADJ35141 |
| 573, 574 | ENDO-1,4-BETA-XYLANASE A PRECURSOR (XYLANASE A) (1,4-BETA-D-XYLAN XYLANOHYDROLASE A) (XYLA). | 2506385 | 1.00E−105 | *Pseudomonas fluorescens* | Xylanase from an environmental sample seq id 14. | ADJ35136 | 0 | Xylanase from an environmental sample seq id 14. | ADJ35135 |
| 575, 576 | Carbohydrate binding family 6 [*Clostridium cellulolyticum* H10] gi|118663312|gb|EAV69968.1| Carbohydrate binding family 6 [*Clostridium cellulolyticum* H10] | 1.19E+08 | 1.00E−135 | *Clostridium cellulolyticum* H10 | Xylanase from an environmental sample seq id 14. | ADJ34872 | 2.00E−84 | Novel human secreted protein seq id 151. | ADN41761 |
| 577, 578 | endo-1,4-beta-xylanase precursor [uncultured bacterium] | 46255070 | 1.00E−120 | uncultured bacterium | Xylanase from an environmental sample seq id 14. | ADJ34942 | 1.00E−120 | Xylanase from an environmental sample seq id 14. | ADJ34941 |

| SEQ ID | Description | GI | E-value | Organism | Annotation | Accession | E-value | Description | Accession |
|---|---|---|---|---|---|---|---|---|---|
| 579, 580 | Endo-1,4-beta-xylanase [Solibacter usitatus Ellin6076] gi|116224961|gb|ABJ83670.1| Endo-1,4-beta-xylanase [Solibacter usitatus Ellin6076] | 1.17E+08 | 1.00E-129 | Solibacter usitatus Ellin6076 | Xylanase from an environmental sample seq id 14. | ADJ35142 | 1.00E-167 | Xylanase from an environmental sample seq id 14. | ADJ35141 |
| 581, 582 | endo-1,4-beta-xylanase precursor [uncultured bacterium] | 46253618 | 4.00E-78 | uncultured bacterium | Xylanase from an environmental sample seq id 14. | ADJ35082 | 0 | Xylanase from an environmental sample seq id 14. | ADJ34957 |
| 583, 584 | family 10 glycosyl hydrolase XynB [Fibrobacter succinogenes S85]. | 11526752 | 5.00E-79 | Fibrobacter succinogenes S85 | Microbulbifer degradans cellulase system protein - SEQ ID 8. | AEH81883 | 6.00E-79 | Human novel protein SEQ ID NO 122. | ADB31515 |
| 585, 586 | beta-1,4-cellobiosidase [Pseudomonas sp. PE2]. | 25137524 | 3.00E-84 | Pseudomonas sp. PE2 | Xylanase from an environmental sample seq id 14. | ADJ35132 | 1.00E-89 | Human secreted protein gene 36 SEQ ID NO: 46. | AAC99935 |
| 587, 588 | xylanase [uncultured organism] | 57639627 | 1.00E-111 | uncultured organism | Xylanase from an environmental sample seq id 14. | ADJ34932 | 1.00E-112 | Xylanase from an environmental sample seq id 14. | ADJ34915 |
| 589, 590 | ENDO-1,4-BETA-XYLANASE A PRECURSOR (XYLANASE A) (1,4-BETA-D-XYLAN XYLANOHYDROLASE A). | 1722904 | 1.00E-123 | Bacteroides ovatus | Xylanase from an environmental sample seq id 14. | ADJ35118 | 1.00E-158 | Xylanase from an environmental sample seq id 14. | ADJ35043 |
| 591, 592 | xylanase/chitin deacetylase-like [Saccharophagus degradans 2-40] | 90022703 | 1.00E-112 | Saccharophagus degradans 2-40 | Xylanase from an environmental sample seq id 14. | ADJ35046 | 1.00E-172 | Xylanase from an environmental sample seq id 14. | ADJ34989 |
| 593, 594 | endo-beta-1,4-xylanase [Cellvibrio mixtus] | 757807 | 1.00E-57 | Cellvibrio mixtus | Xylanase from an environmental sample seq id 14. | ADJ34976 | 4.00E-60 | Novel mouse gene sequence #5. | ADO35732 |
| 595, 596 | endo-1,4-beta-xylanase [Thermobifida fusca YX] | 72163190 | 1.00E-102 | Thermobifida fusca YX | Xylanase from an environmental sample seq id 14. | ADJ35080 | 1.00E-103 | Xylanase from an environmental sample seq id 14. | ADJ35079 |

| | | | | | |
|---|---|---|---|---|---|
| 597, 598 | Surface protein from Gram-positive *cocci*, anchor region [*Clostridium phytofermentans* ISDg] gi|106768036|gb|EAT24745.1| Surface protein from Gram-positive *cocci*, anchor region [*Clostridium phytofermentans* ISDg] | 1.07E+08 | 3.00E-61 | *Clostridium phytofermentans* ISDg | Xylanase from an environmental sample seq id 14. | ADJ35068 | 2.00E-50 | Xylanase from an environmental sample seq id 14. | ADJ34841 |
| 599, 600 | xylanase XynA GH 10 [*Paenibacillus* sp. JDR-2] | 62990090 | 0 | *Paenibacillus* sp. JDR-2 | Xylanase from an environmental sample seq id 14. | ADJ34858 | 0 | Xylanase from an environmental sample seq id 14. | ADJ34857 |
| 601, 602 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 1.00E-84 | *Solibacter usitatus* Ellin6076 | Xylanase from an environmental sample seq id 14. | ADJ34882 | 5.00E-91 | Xylanase from an environmental sample seq id 14. | ADJ34881 |
| 603, 604 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 1.00E-119 | *Solibacter usitatus* Ellin6076 | Xylanase from an environmental sample seq id 14. | ADJ35142 | 1.00E-152 | Xylanase from an environmental sample seq id 14. | ADJ35061 |
| 605, 606 | xylanase [uncultured organism] | 57639627 | 1.00E-120 | uncultured organism | Xylanase from an environmental sample seq id 14. | ADJ34932 | 0 | Xylanase from an environmental sample seq id 14. | ADJ34931 |
| 607, 608 | xylanase/chitin deacetylase-like [*Saccharophagus degradans* 2-40] | 90022703 | 1.00E-134 | *Saccharophagus degradans* 2-40 | Xylanase from an environmental sample seq id 14. | ADJ35046 | 0 | Xylanase from an environmental sample seq id 14. | ADJ34995 |
| 609, 610 | xylanase [uncultured organism] | 57639627 | 1.00E-144 | uncultured organism | Xylanase from an environmental sample seq id 14. | ADJ35110 | 0 | Xylanase from an environmental sample seq id 14. | ADJ35109 |
| 611, 612 | intra-cellular xylanase IXT6 [*Geobacillus stearothermophilus*] | 1.14E+08 | 1.00E-113 | *Geobacillus stearothermophilus* | Xylanase from an environmental sample seq id 14. | ADJ35078 | 1.00E-114 | Xylanase from an environmental sample seq id 14. | ADJ35139 |

| | | | | | |
|---|---|---|---|---|---|
| 613, 614 | xylanase [uncultured organism] | 57639627 | 1.00E-121 | uncultured organism | Xylanase from an environmental sample seq id 14. | ADJ34932 | 0 | Xylanase from an environmental sample seq id 14. | ADJ34931 |
| 615, 616 | celloxylanase CelW [*Clostridium stercorarium*]. | 23304849 | 1.00E-116 | *Clostridium stercorarium* | *Streptomyces* sp. Bgal gene RBS RNA fragment. | AAW93148 | 1.00E-117 | Xylanase from an environmental sample seq id 14. | ADJ34795 |
| 617, 618 | ENDO-1,4-BETA-XYLANASE A PRECURSOR (XYLANASE A) (1,4-BETA-D-XYLAN XYLANOHYDROLASE A). | 1722904 | 1.00E-127 | *Bacteroides ovatus* | Xylanase from an environmental sample seq id 14. | ADJ35044 | 1.00E-140 | Xylanase from an environmental sample seq id 14. | ADJ34905 |
| 619, 620 | endo-1;4-beta-xylanase [*Bacillus* sp. YA-335] | 1334251 | 4.00E-56 | *Bacillus* sp. YA-335 | Xylanase from an environmental sample seq id 14. | ADJ35102 | 2.00E-86 | Xylanase from an environmental sample seq id 14. | ADJ35101 |
| 621, 622 | Endo-1,4-beta-xylanase [*Solibacter usitatus* Ellin6076] gi|116224961|gb|ABJ83670.1| Endo-1,4-beta-xylanase [*Solibacter usitatus* Ellin6076] | 1.17E+08 | 2.00E-95 | *Solibacter usitatus* Ellin6076 | Xylanase from an environmental sample seq id 14. | ADJ35056 | 1.00E-173 | Xylanase from an environmental sample seq id 14. | ADJ35055 |
| 623, 624 | endo-beta-1;4-xylanase [*Cellvibrio mixtus*] | 757809 | 6.00E-97 | *Cellvibrio mixtus* | Xylanase from an environmental sample seq id 14. | ADJ35126 | 3.00E-97 | *Vibrio harveyi* endoglucanase DNA. | AAT94196 |
| 625, 626 | xylanase/chitin deacetylase-like [*Saccharophagus degradans* 2-40] | 90022703 | 1.00E-114 | *Saccharophagus degradans* 2-40 | Xylanase from an environmental sample seq id 14. | ADJ35046 | 0 | Xylanase from an environmental sample seq id 14. | ADJ34995 |
| 627, 628 | xylanase 5 [*Aeromonas punctata*]. | 27227837 | 0 | *Aeromonas punctata* | Xylanase from an environmental sample seq id 14. | ADJ34858 | 0 | Xylanase from an environmental sample seq id 14. | ADJ34857 |
| 629, 630 | Endo-1,4-beta-xylanase [*Saccharophagus degradans* 2-40] | 90022278 | 1.00E-126 | *Saccharophagus degradans* 2-40 | Xylanase from an environmental sample seq id 14. | ADJ34932 | 1.00E-138 | Bacterial polypeptide #10001. | ADS63654 |
| 631, 632 | xylanase [uncultured organism] | 57639627 | 1.00E-116 | uncultured organism | Xylanase from an environmental sample seq id 14. | ADJ34932 | 1.00E-130 | Xylanase from an environmental sample seq id 14. | ADJ34931 |

| SEQ ID NO | NR Description | | | | | | |
|---|---|---|---|---|---|---|---|
| 633, 634 | glycoside hydrolase, family 8 [Clostridium cellulolyticum H10] gi\|118665052\|gb\|EAV71675.1\| glycoside hydrolase, family 8 [Clostridium cellulolyticum H10] | 1.19E+08 | 2.00E-66 | Clostridium cellulolyticum H10 | Xylanase from an environmental sample seq id 14. | 8.00E-66 | ADJ34789 |
| 635, 636 | endo-beta-1,4-xylanase [Cellvibrio mixtus] | 757807 | 1.00E-58 | Cellvibrio mixtus | Xylanase from an environmental sample seq id 14. | 4.00E-60 | AAD02809 |

| SEQ ID NO: | NR Description | Geneseq DNA Accession Code | Geneseq DNA Evalue | Predicted EC Number | Query DNA Length | Query Protein Length | Geneseq/NR DNA Length | Geneseq/NR Protein Length | Geneseq/NR Protein | Geneseq/NR % ID Protein | Geneseq/NR % ID DNA |
|---|---|---|---|---|---|---|---|---|---|---|---|
| 385, 386 | family F xylanase [Fusarium oxysporum f. sp. lycopersici]. | AAF88315 | 0.27 | 3.2.1.4 | 1122 | 373 | 1155 | 384 | | 52 | 62 |
| 387, 388 | xylanase T-6 [Geobacillus stearothermophilus] | AAQ92862 | 2.00E-05 | 3.2.1.8 | 1221 | 406 | 0 | 407 | | 75 | 64 |
| 389, 390 | endoglucanase [Erwinia rhapontici]. | AAN70617 | 2.00E-05 | 3.2.1.4 | 1008 | 335 | 1002 | 333 | | 66 | 66 |
| 391, 392 | probable endoglucanase precursor [Salmonella enterica subsp. enterica serovar Paratypi A str. ATCC 9150] | AAS90145 | 1.00E-21 | 3.2.1.4 | 1116 | 371 | 0 | 369 | | 77 | 75 |
| 393, 394 | unnamed protein product [Bacillus circulans] | ABZ34864 | 0.11 | | 1677 | 558 | 0 | 409 | | 31 | 39 |
| 395, 396 | endoglucanase-N257 [Bacillus circulans]. | AAK99798 | 0 | 3.2.1.8 | 1224 | 407 | 1224 | 407 | | 97 | 94 |
| 397, 398 | endo-1,4-beta-xylanase A [Thermotoga maritima]. | AAT08143 | 1.00E-08 | 3.2.1.8 | 741 | 246 | 3180 | 1059 | | 56 | 64 |
| 399, 400 | alpha-L-arabinofuranosidase ArfA [Clostridium cellulovorans]. | ABQ58362 | 0.65 | 3.2.1.55 | 2637 | 878 | 1479 | 492 | | 32 | 30 |
| 401, 402 | xylanase T-6 [Geobacillus stearothermophilus] | AAQ92862 | 2.00E-11 | 3.2.1.8 | 1242 | 413 | 0 | 407 | | 71 | 68 |
| 403, 404 | xylanase precursor [Bacteroides ovatus] | AAT63566 | 5.00E-09 | 3.2.1.8 | 1158 | 385 | 0 | 376 | | 45 | 53 |
| 405, 406 | beta-1,4-xylanase [uncultured bacterium] | AAT63561 | 2.00E-08 | 3.2.1.8 | 1065 | 354 | 0 | 360 | | 39 | 48 |
| 407, 408 | glycosyl hydrolase, family 10 [Caulobacter crescentus]. | AAC49543 | 1.1 | 3.2.1.8 | 1173 | 390 | 1131 | 376 | | 50 | 59 |
| 409, 410 | ENDO-1,4-BETA-XYLANASE I PRECURSOR (XYLANASE I) (1,4-BETA-D-XYLAN XYLANOHYDROLASE I). | AAQ42685 | 1.00E-32 | 3.2.1.8 | 630 | 209 | 2059 | 211 | | 77 | 76 |

| | | | | | | | | |
|---|---|---|---|---|---|---|---|---|
| 411, 412 | endoxylanase II; pI9 [*Hypocrea jecorina*] | AAV81332 | ###### | 3.2.1.8 | 666 | 221 | 1015 | 223 | 92 | 86 |
| 413, 414 | COG3405: Endoglucanase Y [*Clostridium thermocellum* ATCC 27405] | AAV07164 | 0.14 | 3.2.1.8 | 2244 | 747 | 0 | 477 | 20 | 31 |
| 415, 416 | probable endoglucanase precursor [*Salmonella enterica* subsp. *enterica* serovar Paratypi A str. ATCC 9150] | AAS88676 | 2.00E-26 | 3.2.1.4 | 1107 | 368 | 0 | 369 | 74 | 73 |
| 417, 418 | Endoglucanase precursor [*Escherichia coli* CFT073] gi|26110594|gb|AAN82779.1| Endoglucanase precursor [*Escherichia coli* CFT073] | AAS88676 | 0 | 3.2.1.4 | 1107 | 368 | 0 | 370 | 100 | 100 |
| 419, 420 | I40696|endoglucanase - *Cellulomonas uda* | AAN70617 | 2.00E-17 | 3.2.1.4 | 990 | 329 | 1828 | 359 | 61 | 68 |
| 421, 422 | xylanase III [*Hypocrea jecorina*] | ABZ51818 | 0.97 | 3.2.1.8 | 1044 | 347 | 1044 | 347 | 82 | 75 |
| 423, 424 | COG3405: Endoglucanase Y [*Ralstonia eutropha* JMP134] | AAV58939 | 0.32 | 3.2.1.4 | 1335 | 444 | 0 | 392 | 58 | 62 |
| 425, 426 | putative beta-1,4-xylanase [*Streptomyces avermitilis* MA-4680] | AAI61373 | 0.29 | 3.2.1.8 | 1221 | 406 | 0 | 451 | 29 | 43 |
| 427, 428 | 1N82|B The High-Resolution Crystal Structure Of 1xt6; A Thermophilic; Intracellular Xylanase From G. Stearothermophilus | AAQ92862 | 0.001 | 3.2.1.8 | 996 | 331 | 0 | 331 | 99 | 54 |
| 429, 430 | putative endoglucanase [*Escherichia coli* O157:H7 EDL933] | AAS88676 | 0 | 3.2.1.4 | 1107 | 368 | 1107 | 368 | 99 | 98 |
| 431, 432 | ENDO-1,4-BETA-XYLANASE PRECURSOR (XYLANASE) (1,4-BETA-D-XYLAN XYLANOHYDROLASE) (FIA-XYLANASE). | AAQ74636 | 0 | 3.2.1.8 | 984 | 327 | 0 | 327 | 98 | |
| 433, 434 | xylanase I [*Streptomyces thermoviolaceus*] | AAA12986 | 5.00E-18 | 3.2.1.8 | 1134 | 377 | 0 | 476 | 59 | |
| 435, 436 | family F xylanase [*Fusarium oxysporum f.* sp. *lycopersici*]. | AAI72046 | 2.00E-88 | 3.2.1.8 | 1116 | 371 | 3028 | 384 | 74 | |
| 437, 438 | I40696|endoglucanase - *Cellulomonas uda* | ABK13050 | 3.00E-07 | 3.2.1.4 | 993 | 330 | 11772 | 359 | 59 | |
| 439, 440 | intra-cellular xylanase [*Bacillus stearothermophilus*] | AAF61948 | 0.97 | 3.2.1.8 | 1041 | 346 | 996 | 331 | 61 | 60 |
| 441, 442 | ORF_ID: tlr1902-probable endo-1,4-beta-xylanase [*Thermosynechococcus elongatus* BP-1]. | ABL29515 | 0.29 | 3.2.1.8 | 1239 | 412 | 1158 | 385 | 26 | 44 |
| 443, 444 | COG3693: Beta-1,4-xylanase [*Microbulbifer degradans* 2-40] | AAT94196 | 0 | 3.2.1.8 | 912 | 303 | 849 | 282 | 92 | |

-continued

| | | | | | | | | |
|---|---|---|---|---|---|---|---|---|
| 445, 446 | intra-cellular xylanase [uncultured bacterium] | ABQ94225 | 4.4 | 3.2.1.8 | 1191 | 396 | 0 | 336 | 38 |
| 447, 448 | putative endoglucanase [*Escherichia coli* O157:H7 EDL933]. | AAS90145 | 2.00E-17 | 3.2.1.4 | 1107 | 368 | 1107 | 368 | 71 | 70 |
| 449, 450 | endo-1,4-D-glucanase [*Salmonella typhimurium* LT2]. | AAS90145 | 3.00E-19 | 3.2.1.4 | 1107 | 368 | 1110 | 369 | 73 | 72 |
| 451, 452 | I39760 endo-1,4-beta-xylanase (EC 3.2.1.8)-*Bacillus stearothermophilus* | ABK82442 | 0.61 | 3.2.1.8 | 681 | 226 | 0 | 330 | 76 | |
| 453, 454 | hypothetical protein FG06445.1 [*Gibberella zeae* PH-1] | AAT74074 | 7.00E-14 | | 1002 | 333 | 0 | 367 | 56 | |
| 455, 456 | COG3693: Beta-1,4-xylanase [*Clostridium thermocellum* ATCC 27405] | AAZ51817 | 0 | 3.2.1.8 | 2823 | 940 | 0 | 1077 | 99 | |
| 457, 458 | probable endoglucanase precursor [*Salmonella enterica* subsp. *enterica* serovar Paratypi A str. ATCC 9150] | AAS94208 | 1.00E-21 | 3.2.1.4 | 984 | 327 | 0 | 369 | 74 | |
| 459, 460 | endoxylanase [*Alternaria alternata*]. | AAQ74636 | 1.00E-07 | 3.2.1.8 | 1524 | 507 | 1281 | 426 | 55 | 56 |
| 461, 462 | endo-1,4-beta-D-glucanase precursor [*Pectobacterium chrysanthemi*]. | AAN70617 | 2.00E-20 | 3.2.1.4 | 990 | 329 | 999 | 332 | 58 | 64 |
| 463, 464 | 1N82 IB The High-Resolution Crystal Structure Of Ixt6; A Thermophilic; Intracellular Xylanase From *G. Stearothermophilus* | AAT63571 | 0.004 | 3.2.1.8 | 1023 | 340 | 0 | 331 | 62 | |
| 465, 466 | xylanase [*Thermotoga neapolitana*] | AAT62589 | 2.00E-68 | 3.2.1.8 | 2142 | 713 | 0 | 1055 | 75 | |
| 467, 468 | endoglucanase fragment [*Aquifex aeolicus*]. | ABL34326 | 0.9 | 3.2.1.4 | 978 | 325 | 978 | 325 | 100 | 100 |
| 469, 470 | COG3693: Beta-1,4-xylanase [*Clostridium thermocellum* ATCC 27405] | AAZ54296 | 1.9 | 3.2.1.8 | 1929 | 642 | 0 | 639 | 35 | |
| 471, 472 | xylanase precursor [*Bacteroides ovatus*] | AAT63566 | 0.001 | 3.2.1.8 | 1119 | 372 | 0 | 376 | 40 | |
| 473, 474 | intra-cellular xylanase [uncultured bacterium] | ABL18193 | 0.061 | 3.2.1.8 | 1020 | 339 | 0 | 336 | 36 | |
| 475, 476 | endo-1,4-beta-xylanase [*Thermobacillus xylanilyticus*]. | AAA12989 | 0.005 | 3.2.1.8 | 1248 | 415 | 1104 | 367 | 35 | 50 |
| 477, 478 | chitosanase-glucanase [*Bacillus* sp. D-2]. | AAF08031 | 0.54 | | 2199 | 732 | 2394 | 797 | 38 | 54 |
| 479, 480 | xylanase [*Aspergillus niger*] | AAV19126 | 1.00E-14 | 3.2.1.8 | 636 | 211 | 558 | 211 | 72 | |

| SEQ ID NO: | NR Description | Geneseq DNA Evalue | Query DNA Length | Query Protein Length | Geneseq/NR DNA Length | Geneseq/NR Protein Length | Geneseq/NR % ID Protein | Geneseq/NR % ID DNA |
|---|---|---|---|---|---|---|---|---|
| 483, 484 | family 10 xylanase [*Caldicellulosiruptor* sp. Rt69B.1] | 0 | 2532 | 843 | 0 | 1595 | 79 | |
| 485, 486 | Xylanase, glycosyl hydrolase family 10 [*Clostridium acetobutylicum*] | 3.4 | 1242 | 413 | 3433 | 430 | | |
| 487, 488 | Endo-1,4-beta-xylanase [*Solibacter usitatus* Ellin6076] | 2.00E-07 | 1152 | 383 | 1218 | 384 | | |
| 489, 490 | gi|116224961|gb|ABJ83670.1|Endo-1,4-beta-xylanase [*Solibacter usitatus* Ellin6076] | 2.00E-16 | 1170 | 389 | 1407 | 384 | | |
| 491, 492 | Methionine biosynthesis MetW [*Saccharophagus degradans* 2-40] | 7.00E-05 | 1530 | 509 | 0 | 1186 | 67 | |
| 493, 494 | Glycoside hydrolase, family 10: *Clostridium* cellulosome enzyme, dockerin type I: Carbohydrate-binding, CenC-like [*Clostridium thermocellum* ATCC 27405] | 0.022 | 1959 | 652 | 0 | 639 | 22 | |
| 495, 496 | gi|67851540|gb|EAM47104.1| Glycoside hydrolase, family 10: *Clostridium* cellulosome enzyme, dockerin type I: Endo-1,4-beta-xylanase [*Solibacter usitatus* Ellin6076] | 1.00E-11 | 1125 | 374 | 1407 | 389 | | |
| 497, 498 | endo-1,4-beta-xylanase precursor [uncultured bacterium] | 1.00E-11 | 1008 | 335 | 852 | 279 | | |
| 499, 500 | Endo-1,4-beta-xylanase [*Solibacter usitatus* Ellin6076] gi|116224961|gb|ABJ83670.1|Endo-1,4-beta-xylanase [*Solibacter usitatus* Ellin6076] | 0 | 1155 | 384 | 1155 | 384 | | |
| 501, 502 | endo-1,4-beta-xylanase XynI [*Cellulomonas flavigena*] | 1.00E-66 | 744 | 247 | 1086 | 361 | | |
| 503, 504 | endo-beta-1,4-xylanase [*Cellvibrio mixtus*] | 8.00E-14 | 1545 | 514 | 847 | 350 | | |
| 505, 506 | xylanase/chitin deacetylase-like [*Saccharophagus degradans* 2-40] | 2.00E-62 | 1059 | 352 | 1068 | 355 | | |
| 507, 508 | xylanase/chitin deacetylase-like [*Saccharophagus degradans* 2-40] | 1.00E-131 | 1062 | 353 | 1068 | 361 | | |
| 509, 510 | Carbohydrate binding family 6 [*Clostridium cellulolyticum* H10] gi|118663312|gb|EAV69968.1| Carbohydrate binding family 6 [*Clostridium cellulolyticum* H10] | 0.11 | 2325 | 774 | 0 | 541 | | |

| | | | | | | |
|---|---|---|---|---|---|---|
| 511, 512 | beta-1,4-xylanase [*Pseudomonas* sp. ND137] | 1.00E-42 | 1107 | 368 | 1068 | 445 | |
| 513, 514 | endo-1,4-beta-xylanase [*Bacillus* sp. YA-335] | 1.00E-08 | 1089 | 362 | 0 | 354 | 68 |
| 515, 516 | alkaline active endoxylanase precursor [*Bacillus halodurans*] | 3.00E-31 | 1188 | 395 | 0 | 396 | 77 |
| 517, 518 | xylanase/chitin deacetylase-like [*Saccharophagus degradans* 2-40] | 6.00E-49 | 1728 | 575 | 1629 | 542 | |
| 519, 520 | xylanase/chitin deacetylase-like [*Saccharophagus degradans* 2-40] | 6.00E-64 | 1473 | 490 | 1086 | 542 | |
| 521, 522 | xylanase [uncultured organism] | 2.00E-26 | 1155 | 384 | 1146 | 381 | |
| 523, 524 | endo-beta-1;4-xylanase [*Celvibrio mixtus*] | 7.00E-05 | 1533 | 510 | 8298 | 303 | |
| 525, 526 | Methionine biosynthesis MetW [*Saccharophagus degradans* 2-40] | 4.00E-11 | 3048 | 1015 | 0 | 1186 | 65 |
| 527, 528 | xylanase [uncultured organism] | 6.00E-11 | 1140 | 379 | 1116 | 381 | |
| 529, 530 | xylanase [uncultured bacterium] | 4.00E-29 | 696 | 231 | 1086 | 222 | |
| 531, 532 | endo-beta-1,4-xylanase [*Celvibrio mixtus*] | 0.069 | 1551 | 516 | 0 | 656 | 32 |
| 533, 534 | Methionine biosynthesis MetW [*Saccharophagus degradans* 2-40] | 1.00E-06 | 1359 | 452 | 1725 | 1186 | |
| 535, 536 | endo-beta-1,4-xylanase [*Bacillus* sp.] | 2.00E-10 | 1002 | 333 | 1011 | 336 | |
| 537, 538 | Endo-1,4-beta-xylanase [*Saccharophagus degradans* 2-40] | 2.00E-04 | 1137 | 378 | 1146 | 381 | |
| 539, 540 | endo-1,4-beta-xylanase [*Thermobifida fusca* YX] | 1.00E-08 | 1092 | 363 | 1273 | 338 | |
| 541, 542 | xylanase X [*Paenibacillus* sp. BL11] | 4.00E-24 | 1155 | 384 | 164 | 355 | |
| 543, 544 | intra-cellular xylanase [uncultured bacterium] | 2.00E-04 | 1014 | 337 | 1011 | 346 | |
| 545, 546 | ENDO-1,4-BETA-XYLANASE A PRECURSOR (XYLANASE A) (1,4-BETA-D-XYLAN XYLANOHYDROLASE A). | 6.00E-11 | 1143 | 380 | 1905 | 383 | |
| 547, 548 | xylanase [uncultured organism] | 0.003 | 1149 | 382 | 1146 | 381 | |
| 549, 550 | endo-beta-1,4-xylanase [*Bacillus* sp.] | 2.00E-04 | 981 | 326 | 3972 | 336 | |
| 551, 552 | ENDO-1,4-BETA-XYLANASE A PRECURSOR (XYLANASE A) (1,4-BETA-D-XYLAN XYLANOHYDROLASE A) (XYLA). | 7.00E-11 | 1470 | 489 | 1860 | 619 | |
| 553, 554 | endo-1;4-beta-xylanase precursor [uncultured bacterium] | 4.00E-67 | 1116 | 371 | 1110 | 369 | |
| 555, 556 | xylanase [*Microbulbifer hydrolyticus*] | 1.00E-42 | 1071 | 356 | 1068 | 445 | |
| 557, 558 | xylanase/chitin deacetylase-like [*Saccharophagus degradans* 2-40] | 7.00E-17 | 1371 | 456 | 1086 | 361 | |

| SEQ ID | Description | | | | | |
|---|---|---|---|---|---|---|
| 559, 560 | endo-beta-1,4-xylanase [Bacillus sp.] | 3.00E−06 | 996 | 331 | 1041 | 336 |
| 561, 562 | ENDO-1,4-BETA-XYLANASE A PRECURSOR (XYLANASE A) (1,4-BETA-D-XYLAN XYLANOHYDROLASE A) (XYLA). | 3.00E−26 | 1809 | 602 | 1860 | 619 |
| 563, 564 | CHU large protein; candidate b-glycosidase; glycoside hydrolase family 8 protein [Cytophaga hutchinsonii ATCC 33406] | 0.37 | 2067 | 688 | 0 | 1152 | 29 |
| 565, 566 | Methionine biosynthesis MetW [Saccharophagus degradans 2-40] | 2.00E−08 | 1515 | 504 | 0 | 1186 | 68 |
| 567, 568 | xylanase [uncultured organism] | 1.00E−42 | 1158 | 385 | 1146 | 381 |
| 569, 570 | Possible xylan degradation enzyme (glycosyl hydrolase family 30-like domain and Ricin B-like domain) [Clostridium acetobutylicum]. | 0.73 | 1062 | 353 | 1761 | 586 | 33 |
| 571, 572 | Endo-1,4-beta-xylanase [Solibacter usitatus Ellin6076] gi|116224961|gb|ABJ83670.1|Endo-1,4-beta-xylanase [Solibacter usitatus Ellin6076] | 3.00E−25 | 1149 | 382 | 1155 | 384 |
| 573, 574 | ENDO-1,4-BETA-XYLANASE A PRECURSOR (XYLANASE A) (1,4-BETA-D-XYLAN XYLANOHYDROLASE A) (XYLA). | 2.00E−11 | 1326 | 441 | 1860 | 619 |
| 575, 576 | Carbohydrate binding family 6 [Clostridium cellulolyticum H10] gi|118663312|gb|EAV69968.1| Carbohydrate binding family 6 [Clostridium cellulolyticum H10] | 0.01 | 876 | 291 | 0 | 541 | 46 |
| 577, 578 | endo-1,4-beta-xylanase precursor [uncultured bacterium] | 0 | 642 | 213 | 0 | 214 | 97 |
| 579, 580 | Endo-1,4-beta-xylanase [Solibacter usitatus Ellin6076] gi|116224961|gb|ABJ83670.1|Endo-1,4-beta-xylanase [Solibacter usitatus Ellin6076] | 1.00E−11 | 1158 | 385 | 1155 | 384 |
| 581, 582 | endo-1,4-beta-xylanase precursor [uncultured bacterium] | 3.00E−04 | 1596 | 531 | 1503 | 613 |
| 583, 584 | family 10 glycosyl hydrolase XynB [Fibrobacter succinogenes S85]. | 2.00E−04 | 1362 | 453 | 1761 | 586 | 38 |
| 585, 586 | beta-1,4-cellobiosidase [Pseudomonas sp. PE2]. | 3.2 | 1188 | 395 | 798 | 597 |
| 587, 588 | xylanase [uncultured organism] | 0.003 | 1095 | 364 | 1218 | 381 | 51 |

| | | | | | | | |
|---|---|---|---|---|---|---|---|
| 589, 590 | ENDO-1,4-BETA-XYLANASE A PRECURSOR (XYLANASE A) (1,4-BETA-D-XYLAN XYLANOHYDROLASE A). | 1.00E-05 | 1149 | 382 | 1143 | 383 | |
| 591, 592 | xylanase/chitin deacetylase-like [*Saccharophagus degradans* 2-40] | 5.00E-16 | 2094 | 697 | 1068 | 542 | |
| 593, 594 | endo-beta-1,4-xylanase [*Cellvibrio mixtus*] | 3.00E-06 | 1137 | 378 | 2557 | 350 | |
| 595, 596 | endo-1,4-beta-xylanase [*Thermobifida fusca* YX] | 3.00E-21 | 978 | 325 | 1134 | 377 | |
| 597, 598 | Surface protein from Gram-positive cocci, anchor region [*Clostridium phytofermentans* ISDg] gi|106768036|gb|EAT24745.1|Surface protein from Gram-positive cocci, anchor region [*Clostridium phytofermentans* ISDg] | 0.021 | 1842 | 613 | 0 | 806 | 29 |
| 599, 600 | xylanase XynA GH 10 [*Paenibacillus* sp. JDR-2] | 1.00E-08 | 3801 | 1266 | 0 | 1467 | 58 |
| 601, 602 | Endo-1,4-beta-xylanase [*Solibacter usitatus* Ellin6076] gi|116224961|gb|ABJ83670.1|Endo-1,4-beta-xylanase [*Solibacter usitatus* Ellin6076] | 3.00E-10 | 1536 | 511 | 1407 | 468 | |
| 603, 604 | Endo-1,4-beta-xylanase [*Solibacter usitatus* Ellin6076] gi|116224961|gb|ABJ83670.1|Endo-1,4-beta-xylanase [*Solibacter usitatus* Ellin6076] | 0.003 | 1167 | 388 | 1128 | 384 | |
| 605, 606 | xylanase [uncultured organism] | 0 | 1146 | 381 | 1146 | 381 | |
| 607, 608 | xylanase/chitin deacetylase-like [*Saccharophagus degradans* 2-40] | 9.00E-60 | 1515 | 504 | 1086 | 542 | |
| 609, 610 | xylanase [uncultured organism] | 0 | 1146 | 381 | 1146 | 381 | |
| 611, 612 | intra-cellular xylanase IXT6 [*Geobacillus stearothermophilus*] | 7.00E-07 | 993 | 330 | 1125 | 333 | |
| 613, 614 | xylanase [uncultured organism] | 0 | 1146 | 381 | 1146 | 381 | |
| 615, 616 | celloxylanase CelW [*Clostridium stercorarium*]. | 0.33 | 1875 | 624 | 1224 | 388 | |
| 617, 618 | ENDO-1,4-BETA-XYLANASE A PRECURSOR (XYLANASE A) (1,4-BETA-D-XYLAN XYLANOHYDROLASE A). | 4.00E-12 | 1152 | 383 | 1905 | 380 | |

| | | | | | | |
|---|---|---|---|---|---|---|
| 619, 620 | endo-1;4-beta-xylanase [*Bacillus* sp. YA-335] | 1.00E−16 | 582 | 193 | 1695 | 564 |
| 621, 622 | Endo-1,4-beta-xylanase [*Solibacter usitatus* Ellin6076] gi|116224961|gb|ABJ83670.1|Endo-1,4-beta-xylanase [*Solibacter usitatus* Ellin6076] | 4.00E−67 | 1134 | 377 | 1128 | 375 |
| 623, 624 | endo-beta-1;4-xylanase [*Celvibrio mixtus*] | 0.054 | 1215 | 404 | 849 | 448 |
| 625, 626 | xylanase/chitin deacetylase-like [*Saccharophagus degradans* 2-40] | 9.00E−11 | 1812 | 603 | 1086 | 542 |
| 627, 628 | xylanase 5 [*Aeromonas punctata*]. | 4.00E−05 | 3354 | 1117 | 3981 | 1326 | 32 |
| 629, 630 | Endo-1,4-beta-xylanase [*Saccharophagus degradans* 2-40] | 2.00E−04 | 1143 | 380 | 1116 | 381 |
| 631, 632 | xylanase [uncultured organism] | 1.00E−08 | 1143 | 380 | 1146 | 381 |
| 633, 634 | glycoside hydrolase, family 8 [*Clostridium cellulolyticum* H10] gi|118665052|gb|EAV71675.1| glycoside hydrolase, family 8 [*Clostridium cellulolyticum* H10] | 7.00E−11 | 1398 | 465 | 0 | 477 |
| 635, 636 | endo-beta-1;4-xylanase [*Celvibrio mixtus*] | 0.009 | 834 | 277 | 2109 | 350 | 44 |

SEQUENCE LISTING (636 sequences)

SEQ ID NO: 1 - DNA, 1128 bp, Unknown
  misc_feature: Bacterial DNA
atgaccgaccacaacgcttccgaaaccagcctgttcgaacagtgcggctacagccgcgaggccatccaggcccgcctggagcgcaactggtatgagatgttcgaaggcccggacaagatttactgggagaacgacgaaggcctggggtacgtgatggacaccggcaaccacgacgtgcgcaccgagggcatgagctacgcgatgatgatcgccgtgcagtacggccgcaaggacgtgttcgacaagctgtggggttgggtcatgaaatacatgttcatgaccgagggcctgcaccagggctacttcgcctggtctgtggaccccagcggcgtaccgaacgccgacggtccggccccggacggcgaggaatacttcgcgatggacctgttcctggcctccgcgcgatggggcgacggcgaaggcgtgtacgagtactcccgccacgcccgctcgatcctccacacctgcgtgcaccagggcgaggacggtgaaggctatccgatgtggaacccggagaaccatctgatcaagttcatcccggaaaccgaatggaccgacccgtcctaccatctgccgcacttctacgaggtgttcgccgagcgcgccgacgaggccgaccgtccgttctgggcgcaggccgccaaggcgagccgcgagtacctggtcaccgcctgccacccgcagaccggcatgaaccccgaatactcaaactatgatggcacgccgcacgtcgacgagcgcgaccactggcatttctactccgacgcctaccgcaccgccggcaacatcgggctggactgcctgtggaacggcgtcgtgccggaactgtgcgatgcgaatgcgcgtctgcagcgtttcttcctcgaacacgaccgcacctgcgtgtatgcgatcgacggcacgccggtggacgagaccgtgctgcacccggtcggcttcatcgccgccaccgccgaaggctcgctcgccgcgatgcactcgcaggagccggacgcgctcgacaacgcgatccgctgggtgcgcctgctgtgggacaccccgatccgcaccggcacgcgccgctactacgacaacttcctctacgccttcgcgttcctggcgctggcgggggagtaccgcacctggtga

SEQ ID NO: 2 - protein, 375 aa, Unknown
  DOMAIN (1)...(375): Bacterial protein
MTDHNASETSLFEQCGYSREAIQARLERNWYEMFEGPDKIYWENDEGLGYVMDTGNHDVRTEGMSYAMMIAVQYGRKDVFDKLWGWVMKYMFMTEGLHQGYFAWSVDPSGVPNADGPAPDGEEYFAMDLFLASARWGDGEGVYEYSRHARSILHTCVHQGEDGEGYPMWNPENHLIKFIPETEWTDPSYHLPHFYEVFAERADEADRPFWAQAAKASREYLVTACHPQTGMNPEYSNYDGTPHVDERDHWHFYSDAYRTAGNIGLDCLWNGVVPELCDANARLQRFFLEHDRTCVYAIDGTPVDETVLHPVGFIAATAEGSLAAMHSQEPDALDNAIRWVRLLWDTPIRTGTRRYYDNFLYAFAFLALAGEYRTW

SEQ ID NO: 3 - DNA, 2196 bp, Unknown
  Obtained from an environmental sample
atgttcaaagaatggggaaagaccgactcggaaattaccacaaaagtaaacaccgcgtggaacaaactgtttgttaacggggtggaatccggagataatgccgaaagaatctatgtagagactggaagcgacatggcgtacatccatacctttgacagcaacgacgtgcgctccgaaggaatgtcctacggcatgatgatgtgcgtacagatgaacgatcagacaagatttaacaaactctggaaatgggcaagaacctatatgtacaatgaaacagacgccggcagtaattccaggggctatttctcatggcagtgcagtacaagcggctcaaaaatggataagggccccgctcctgacggcgaggaatactttattacggcgctgttgttcgcgcacgcccgctgggggagcgcgtccggtactacaaacataaacaattacgcgcagcaagcaaggcagattatctatgacttaacgcgccgcaaaccggggaacggagatccttacggcgagccttcaatgtttaatgtagacaactatatggttagattcgccacacttggaaattccgccacctttacagacccctcataccatttaccggcattctatgatgtttgggcgctggaattacaggcggactatgataatagtaaactctacggtatctgggctgataaggctgacttgaaaaaagacattgattactttaaacaagcggcgaccacaagccgttcattctttgcaaaaacgacaaacggtacaaccggacttggaccggattatgccggctttgacggaacgcctaaaaatgaaggggatcacaagtatttcgagtatgacgcgtggcgtatcgcgatgaacataggtatggactacgcgtggttcgcgaaagattcctggcagaagacatttgccgacagaattcaggcgttctttgtcagcaagggagtcacttcttacggaaaccgctggacattggacgggactcaaaggggagcggatcactcgccgggtcttgtcggctgtaacgcggtcgcctctctcgcggcgacaaacgcgaacgcgtggaaatttatcgaagacttctggaacatcagcatgacgaaaggcaaataccgttactatgacggatgtctgtatatgatgagcatgctgcacttaagcggcaactttaaggcgtatctttctacaaataccacgcccgccaacagttccagcattaccccgacaaccgcgtctttcgacaagaagacaagcgcacaagccgacattgccgtaacagtgacgcttaacgggaatacattctcaagtatcacaaacaacggtacagcccttacaagcggcacagactactcagtgagtggaacaaagtatacgataaagaaagaataccttgcaaaacagcctgtaggaacaacgaagctcgcattcaacttcagtgccggaggaactccggaacttacagttactataacggacacgggcagctccagcatcagcccgacaaccgcgacattcgacaaaaagaccggagcgcaagccgacatcgccgtaaccatgacgcttaatgggaatactttgtcgaacatcaaaaacggttctgcacaacttacaagcggaactgactactcaacgagcggcagtacggtaacgattaaaaaagaatacctggcaaagcaggctaacggcacagtaacgcttaccttcacattcagcgcaggcgcggcccaaactattgacatcacggtaaaagatacaaccggcggagcggcgggaataaaatacaacttcgcaactgacaacctgcccaacgggtacccgaagtacagttcaagtgatatatccgcgacaataaccggaggagctttggtaataaccaaaaccggaaataattcgtccccgaagattacattgccctttagtgtaacaggtaacctttccggttatacaggcataaagataaatgtaaagggagtatccggagatttcacttataaagtattgaatgccgcaataggttctacaaatctcggcagcgtaaataacgccccaataccaaacggctcatttggagacgtaacaataccaataaccggcggtacaaacaccggagatttagatatatcgttctggctcaataacacaaatgcttacgttattgagattaagagcatagagctggtaaaatga

SEQ ID NO: 4 - protein, 711 aa, Unknown
  Obtained from an environmental sample
MFKEWGKTDSEITTKVNTAWNKLFVNGVESGDNAERIYVETGSDMAYIHTFDSNDVRSEGMSYGMMMCVQMNDQTRFNKLWKWARTYMYNETDAGSNSRGYFSWQCSTSGSKMDKGPAPDGEEYFITALLFAHARWGSASGTTNINNYAQQARQIIYDLTRRKPGNGDPYGEPSMFNVDNYMVRFATLGNSATFTDPSYHLPAFYDVWALELQADYDNSKLYGIWADKADLKKDIDYFKQAATTSRSFFAKTTNGTTGLGPDYAGFDGTPKNEGDHKYFEYDAWRIAMNIGMDYAWFAKDSWQKTFADRIQAFFVSKGVTSYGNRWTLDGTQRGADHSPGLVGCNAVASLAATNANAWKFIEDFWNISMTKGKYRYYDGCLYMMSMLHLSGNFKAYLSTNTTPANSSSITPTTASFDKKTSAQADIAVTVTLNGNTFSSITNNGTALTSGTDYSVSGTKYTIKKEYLAKQPVGTTKLAFNFSAGGTPELTVTITDTGSSSISPTTATFDKKTGAQADIAVTMTLNGNTLSNIKNGSAQLTSGTDYSTSGSTVTIKKEYLAKQANGTVTLTFTFSAGAAQTIDITVKDTTGGAAGIKYNFATDNLPNGYPKYSSSDISATITGGALVITKTGNNSSPKITLPFSVTGNLSGYTGIKINVKGVSGDFTYKVLNAAIGSTNLGSVNNAPIPNGSFGDVTIPITGGTNTGDLDIS

SEQ ID NO: 5 - DNA, 2106 bp, Unknown
  Obtained from an environmental sample
atgcaaaacctatttaagcgtgtgtttttccatcttctcttgcttgccttgctggcaggctgtgctggcccttctcccgtaacaccggagccgaccgaaatgccgacccaggtccctacaccaacgcctagtcttggcgcctacgagagcggcgagtatcgcaacctgttcgccgaggcgcttggcaaatcggatgccgaaattcaggccaaaatcgatgccgctttccaacaacttttctacggcgacgatgtttctgagcgcgtctattacccggttggcagcgacatgggctatatgctcgacaccggcaacgacgatgtgcgctccgagggcatgtcctacggcatgatgattgccgtccagatgaacaagaaggaagaattcgaccgcatctggaagtggaccaaaacctacatgtaccagaccgaaggtggttacaaaggttattttgcctggcacgctaaaacggacggcacccaactggccgccaacccggcctctgacggtgaagtctggtttgtgatggcgctcttctttgccgatgcgcgttggggcagcggcgaaggaatttataactaccgcgcccaagcccaggaaattctcgatgtggccttgaacgccaaagaattgggcggcaacctggcgaccaacctgttcgacccggagaccaaacaggtcgtttttgtgccgcagttgggcaataactcgaaatttaccgacgcttcgtaccacatgccccatttctacgagttgtgggcgcgttgggccgataaaaataacgacttttgggccgaagccgctaccgttagccgcgagttcctgcctactgccgttcaccccgaaaccggcctggcccctaactattcctacttcgatggccgcccttacaatgacgagtatcacggccagttccgctacgacgctttccgcgtgggcgcgaacatcggcatggattatgtctggtttcacccctctgaatggtatcgggaacaagccaaccgccaattatctttcttcgcatcccagggcatcgatgattatgttgccgaatattccctggatggaaaaccgctggccgggcatcgcgctacggggttgattgccaccaatgctgtcctggcctacgccgcagaccccgaaattggtcaacccttcgtccaggccctgtgggatgcagagcctccgactggcaggtatcgctactatgacggcctgctctacatgatgggcctgctgcaagccagcggcaacttccgtatttacgagccgggtattacgcctcgcgctgagttgccgcccccgccgcctcgcgccatcgagggccgcttcgcgcccattaccgggcgggccttgcttctgattggcccgaatgcggatggcgtcaacgcttacttcgacaaactggtgacagcgccgggcggcgtgaatgtcgaactatcgctcaaatcgcctgatttggaagcgctcgacgccctggcgaggaaatatcccaacagcacgctttcggtcgggttgtcgctggatggcccggtaacagaggcggatgcgcgggtgggagaattgctcgacgcgttggctgtttatccgcgcccggtcttcctgcgcatcgggccggaatttgatttggcggcgagcggccaggggccggaggaatatgtcgcggcctggaaaacgctccataacgagattcaggcgcggggtagttcgaatatcgccctggtgtggcatagcgccgcagcctgcgagtcgccctttggcggtcatccgctcgaagcgtggtatcccggtgatgagtttgtggattgggtggccgtttcgcgcactgcgcagtctgccgattgcgaggggcagtccgttgaggccgtcttgcagtttgcgcgtgagcgatacaaaccggttgtgttggttgcatcgccagcagaggacatcttcgagttcgtttacgccaacaacgacgtgattcgcgccctgctgtatctgaacaccgagccgggcctgttcgacacccccgaatttttgagcggctggaaggccgaaatcggtcagcagttctggctgcgcggcggcccggcgcttttttcgacactcggattggatgagtaa

SEQ ID NO: 6 - protein, 701 aa, Unknown
  Obtained from an environmental sample
  SIGNAL (1)...(47)
MQNLFKRVFFHLLLLALLAGCAGPSPVTPEPTEMPTQVPTPTPSLGAYESGEYRNLFAEALGKSDAEIQAKIDAAFQQLFYGDDVSERVYYPVGSDMGYMLDTGNDDVRSEGMSYGMMIAVQMNKKEEFDRIWKWTKTYMYQTEGGYKGYFAWHAKTDGTQLAANPASDGEVWFVMALFFADARWGSGEGIYNYRAQAQEILDVALNAKELGGNLATNLFDPETKQVVFVPQLGNNSKFTDASYHMPHFYELWARWADKNNDFWAEAATVSREFLPTAVHPETGLAPNYSYFDGRPYNDEYHGQFRYDAFRVGANIGMDYVWFHPSEWYREQANRQLSFFASQGIDDYVAEYSLDGKPLAGHRATGLIATNAVLAYAADPEIGQPFVQALWDAEPPTGRYRYYDGLLYMMGLLQASGNFRIYEPGITPRAELPPPPPRAIEGRFAPITGRALLLIGPNADGVNAYFDKLVTAPGGVNVELSLKSPDLEALDALARKYPNSTLSVGLSLDGPVTEADARVGELLDALAVYPRPVFLRIGPEFDLAASGQGPEEYVAAWKTLHNEIQARGSSNIALVWHSAAACESPFGGHPLEAWYPGDEFVDWVAVSRTAQSADCEGQSVEAVLQFARERYKPVVLVASPAEDIFEFVYANNDVIRALLYLNTEPGLFDTPEFLSGWKAEIGQQFWLRGGPALFSTLGLDE

SEQ ID NO: 7 - DNA, 1539 bp, Unknown
  Obtained from an environmental sample
atggcacgtttaatcacctattgcttgatcggcgtcttactcgtgatgccagtccttgccgcttgcagcacagcacctacgccaacgctgatgagccagccaacttccacgccgcaaccggccctgcaaccgacgccaccaccgacgagcgtcccccggtcgatcggggcgtttgagtccggtcagtatcgtaatctcttcacggaattactgggcaagagcgaggccgagattcagcagaagatcgatcaggcgtgggcgcagttgttctacggcgacaacgacacgcagcgcgtttactatcccgtgggtcgcgacagggcctacatcaaagacatcggcaacaatgatgtgcgcagtgagggtatgtcgtacggtatgatgctggcggtgcagctggacaagcaggaagagttcaacaaattgtggaagtgggcgcacacctatatgctgcaaaaggatggcccgtacaaaggctattttgcgtggcatgccaatgagaacggtgaacagctggatgcgggtcccgcctccgatggcgaagagtggtttgtcatggcactgctcttcgcggcaaatcgctggggcaacggtgaaggcatctttaattatcaggccgaggcgcagaagatcctggatgtgatgctgcataagagcgaagaggacaacggtctcgccaccagcatgttcgatccggacacgaagcaggtggtgtttgtgccggccgggcgccaggccacattcaccgatccgtcttatcacttgcccgcgttctatgaactgtgggcgcgctgggctgacaaggataacgatttttggaaagaagcggcgcaggccagccgcgaattttggaagaaggcggcgcatccggaaacgggcctgatgtctgactacgccgagtttgacggcagaccccaggccgattctgaacacaaggattttcgctatgacgcgttccgtgtggcgtccaatgtggcgctcgattgggcctggttcgccgccgatccgtgggaggtggaacagagcaatcggttgttggatttcttccgttcacaaggcatggataagtatccgagtctatacaacatcgatggcacgccgttatccactaatcgctcgccgggtttgatcgccatgaacgccacagctggactcgcggctgatccggaaaagagcaaggactttgtgcaggcgctatgggatctggaaattcccagcggacaatggcgctattacgatggggtgctgtatttcctggcgctgttgcaagccagcggcaactatcgcatctacacgcccgatatgcccaaggtggtgcggcccacacctacgcccgatccgatcacgcaagcgaaatttgcacccggcgatgacgcggtgctgttcagtgtggaaacagatgcactcgacgaatatgtgacggcgacgggctttgagccgggcggcgtgatgttgaacactactttggacagcgcctcttttgacgcaccactgcctgacagcgctctgctgatcggattggacgtcagcgatcaataa

SEQ ID NO: 8 - protein, 512 aa, Unknown
  Obtained from an environmental sample
  SIGNAL (1)...(57)
MARLITYCLIGVLLVMPVLAACSTAPTPTLMSQPTSTPQPALQPTPPPTSVPRSIGAFESGQYRNLFTELLGKSEAEIQQKIDQAWAQLFYGDNDTQRVYYPVGRDRAYIKDIGNNDVRSEGMSYGMMLAVQLDKQEEFNKLWKWAHTYMLQKDGPYKGYFAWHANENGEQLDAGPASDGEEWFVMALLFAANRWGNGEGIFNYQAEAQKILDVMLHKSEEDNGLATSMFDPDTKQVVFVPAGRQATFTDPSYHLPAFYELWARWADKDNDFWKEAAQASREFWKKAAHPETGLMSDYAEFDGRPQADSEHKDFRYDAFRVASNVALDWAWFAADPWEVEQSNRLLDFFRSQGMDKYPSLYNIDGTPLSTNRSPGLIAMNATAGLAADPEKSKDFVQALWDLEIPSGQWRYYDGVLYFLALLQASGNYRIYTPDMPKVVRPTPTPDPITQAKFAPGDDAVLFSVETDALDEYVTATGFEPGGVMLNTTLDSASFDAPLPDSALLIGLDVSDQ

SEQ ID NO: 9 - DNA, 1311 bp, Unknown
  Obtained from an environmental sample
atgtttccacgtctttcaccaagccgcttcaggcaagttaccttaaccttgctcacgctcggccttgtgtcactgaccggttgtgcaggtaacagcaagccggatgcagacaccagtactgctggtgccgttgctaccggcgagtaccgcaatctgtttgccgaaatcggaaaaagcgaaatagacatccagcgcaaaattgacgaggcgtttcagcacttgttttatggcgacgcgaaagatgcagctgtctactatcaagcgggtggaaacgagaatggtccactcgcatatgtttacgatgtgaacagcaatgacgtgcgctcagaaggcatgagctacggcatgatgattactgttcaaatggacaaaaaagccgagttcgatgcaatctggaactgggcgaaaacctatatgtatcaagactcccccacgcatccagcgtttggttactttgcctggtccatgcgccgcgatggtgtcgccaatgacgatatgccagcgccagatggcgaggaatatttcgtgaccgctctctatttcgccgccgcccgctggggtaatggcgaaggtattttcaactaccaacaggaagcggacaccattttgagccgcatgcgccaccgccaggtgatcaccggcccaaccaatcgcggagtaatgactgcgaccaatctgttccacccggaagaggcgcaagtgcgcttcacgcccgacatcaataatgctgatcatacagacgcgtcttaccatctgccctcgttctatgaaatttgggcacgtgtcgcgccgcaagaagatcgcgcgttttgggccaaagcggccgatgtgagccgcgactattttgccaaagccgcccaccctgtcactgcgttaacaccggactacggtaattttgatggcaccccgtgggcggcatcctggcggccggagtcggtagattttcgatacgatgcctggcgttccgtcatgaactggtccatggactatgcctggtggggcaaagattcaggcgcacctgcgcgcagtgataaattactcgcgttcttcgaaacccaggaaggcaaaatgaaccacctctatagcctggatggcaaaccgctgggtggtggaccgaccctcggcctaatttccatgaatgcaacggcagctatggcagctactgatccccgctggcacaattttgtggaaaagctctggcaacaacaaccccccacagggcaataccggtactacgacggtgttctatacctgatggcgctgctacattgcgctggggagtacaaagcgtggatccccgacggggaataa

SEQ ID NO: 10 - protein, 436 aa, Unknown
  Obtained from an environmental sample
  SIGNAL (1)...(36)
MFPRLSPSRFRQVTLTLLTLGLVSLTGCAGNSKPDADTSTAGAVATGEYRNLFAEIGKSEIDIQRKIDEAFQHLFYGDAKDAAVYYQAGGNENGPLAYVYDVNSNDVRSEGMSYGMMITVQMDKKAEFDAIWNWAKTYMYQDSPTHPAFGYFAWSMRRDGVANDDMPAPDGEEYFVTALYFAAARWGNGEGIFNYQQEADTILSRMRHRQVITGPTNRGVMTATNLFHPEEAQVRFTPDINNADHTDASYHLPSFYEIWARVAPQEDRAFWAKAADVSRDYFAKAAHPVTALTPDYGNFDGTPWAASWRPESVDFRYDAWRSVMNWSMDYAWWGKDSGAPARSDKLLAFFETQEGKMNHLYSLDGKPLGGGPTLGLISMNATAAMAATDPRWHNFVEKLWQQQPPTGQYRYYDGVLYLMALLHCAGEYKAWIPDGE

SEQ ID NO: 11 - DNA, 1224 bp, Unknown
  Obtained from an environmental sample
atgcggaacgtcgtgcgtaaaccattgacaatcggactcgctttaacactattattgcccatgggaatgacggcaacatcagcgaagaatgcagattcctatgcgaaaaaacctcacatcagcgcattgaatgccccacaattggatcaacgctacaaaaacgagttcacgattggtgcggcagtagaaccttatcaactacaaaatgaaaaagacgtacaaatgctaaagcgccacttcaacagcattgttgccgagaacgtaatgaaaccgatcagcattcaacctgaggaaggaaaattcaattttgaacaagcggatcgaattgtgaagttcgctaaggcaaatggcatggatattcgcttccatacactcgtttggcacagccaagtacctcaacggttctttcttgacaaggaaggtaagccaatggtcaatgaaacagatccagtgaaacgtgaacaaaataaacaactgctgttaaaacgacttgaaactcatattaaaacgatcgtcgagcggtacaaagatgacattaagtactgggacgttgtaaatgaggttgtgggggacgacggaaaactgcgcaactctccatggtatcaaatcgccggcatcgattatattaaagtggcattccaagcagctagaaaatatggcggagacaacattaagctttacatgaatgattacaatacagaagtcgaaccgaagcgaaccgctctttacaatttagtcaaacaactgaaagaagagggtgttccgatcgacggcatcggccatcaatcccacatccaaatcggctggccttctgaagcagaaatcgagaaaacgattaacatgttcgccgctttcggtttagacaaccaaatcactgagcttgatgtgagcatgtacggttggccgccgcgcgcttacccgacgtatgacgccattccaaaacaaaagtttttggatcaggcagcgcgctatgatcgtttgttcaaactgtatgagaagttgagcgataaaattagcaacgtcaccttctggggcatcgccgacaatcatacgtggctcgacagccgtgcggatgtgtactatgacgccaacgggaatgttgtggttgacccgaacgctccgtacgcaaaagtggaaaaagggaaaggaaaagatgcgccgttcgtttttggaccggattacaaagtcaaacccgcatattgggctattattgaccacaaatag

SEQ ID NO: 12 - protein, 407 aa, Unknown
  Obtained from an environmental sample
  SIGNAL (1)...(28)
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQRFFLDKEGKPMVNETDPVKREQNKQLLLKRLETHIKTIVERYKDDIKYWDVVNEVVGDDGKLRNSPWYQIAGIDYIKVAFQAARKYGGDNIKLYMNDYNTEVEPKRTALYNLVKQLKEEGVPIDGIGHQSHIQIGWPSEAEIEKTINMFAAFGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 13 - DNA, 1053 bp, Unknown
  Obtained from an environmental sample
atgaaagacgcgctccagtgctctccccttttcaaagcctatgaaaaatacttccgcatcggcgcggcggttagcagcttcatgacctttgatcccgcttaccgcgccctgatccgccgccattacaattccctgacggcggacaaccagatgaagccggaaagcgtgttggatcgcaccgcgaccctggcgaagggcgacctgctccacgctgcggtggatttcacccgtgtggacgcgctgatgtactttgcacgggacaacgggatccccatgcggtatcacaccctggcctggcacaaccagacgccccgctggttcttcgcgaaggactggagcgacgcggaaagcgccgaacccgcctcaaaggaaaccatgcttgcccgtctggaaaactatatcctggatgtcatgaaccatgtgaataccaagtttcccggtctggtttacacctgggacgtggtaaacgaagccattgagccagagctgaaagccccgggattgtaccggacctggagcccctggttcaaaacctgcggagaagatttcctctttaccgctttccgggccgcccgcaagggacaggcgcccggtcagaccctttgctataacgactataacgccttcgagcccgtcaagcgggacgcgattatcgatctgctgaagaagctgcaggcggaaaacctggtggataccatgggtatgcaggggcattatgtcatggactggatgaacatctcgctctgcgaagaggccgcccgcgcctatgccgccctgggcctgaaggtccaggtcaccgagctggatatccactgcaacagcgacgatgaagcccacagccaaaagctggcgcagctttacggcgattatttcgccatgctgaagaagctgaaggaggaaggcgtcgacatcgaagccgtcaccttctggggcgtcaccgaccaggacagctggctcaccggtttccgtaaagagacaagctatcccctcctcttcgaccgcgccaagcaggccaaggatgcctatgacgccgtcatgaaagccgcggaataa

SEQ ID NO: 14 - protein, 350 aa, Unknown
  Obtained from an environmental sample
MKDALQCSPLFKAYEKYFRIGAAVSSFMTFDPAYRALIRRHYNSLTADNQMKPESVLDRTATLAKGDLLHAAVDFTRVDALMYFARDNGIPMRYHTLAWHNQTPRWFFAKDWSDAESAEPASKETMLARLENYILDVMNHVNTKFPGLVYTWDVVNEAIEPELKAPGLYRTWSPWFKTCGEDFLFTAFRAARKGQAPGQTLCYNDYNAFEPVKRDAIIDLLKKLQAENLVDTMGMQGHYVMDWMNISLCEEAARAYAALGLKVQVTELDIHCNSDDEAHSQKLAQLYGDYFAMLKKLKEEGVDIEAVTFWGVTDQDSWLTGFRKETSYPLLFDRAKQAKDAYDAVMKAAE

SEQ ID NO: 15 - DNA, 1110 bp, Unknown
  Obtained from an environmental sample
atgaaacgtcctctagtcaatctcctgacaaccgcctgcctcctcgttgccgcaaatgctgcagaacccaccctccgcgaagcctacgaaaagcactttgccgtgggtgtcgcactcaataccgctcaagtgactggtcgaaacaaagccgcaggcgaactcgccgcgaagcagttcaattccatcaccgctgagaatgacatgaagtggcaatcgcttcatccagagctcgatacctaccgctttgaatcggccgatgcctatatcgactttgccaaaaagaatgagatggaagtcataggccacactctcgtctggcacagccagacccctcagtgggtgttccaaggcgacgatggcaaacccgcgacacgggaagaacttctcaagcggatgcgcgatcacattcacaaggtcgccggccgatacaagggtaaggtcaagggctgggacgtcgtcaatgaggcgctctccgacggaggtcaggacattctacgcgaatctccgtggcggcgaatcatcggagacgatttcatcgatcacgctttccgctacgcccgcgaagccgacccaaaggcagaactttactacaacgactacaacctcgaaatccctcgcaaacgcgagaactgcatcaagctcgtcaagggcatgcttgagcgcggcgtccccatcgacggcattggaacgcaatcccattttcagcttggcttcccatcgctggaagatgtcgagaccacgattgaagagtttggaaaactcggccttaaggtcatgattaccgaactcgatgtggatgtcctccctcgcaataacccaggcgtcgccgacatcagtcagcgcgagcaaggtagcaatccctacactgagggcctgcccgaggatgttcaaaagcagcttacgaaacgctacgaagacatcttcaagatctacctaaagcaccagaaaacggtcacccgcgtgaccttctggggcctcgatgatggtcaatcatggttgaatggctttcctgttagaggccgcaccaatcacccgctacttttcgatcgtgaactcaaaccgaagcccgttcttccagtcttgatagagctcggcaagaagaagcgataa

SEQ ID NO: 16 - protein, 369 aa, Unknown
  Obtained from an environmental sample
  SIGNAL (1)...(20)
MKRPLVNLLTTACLLVAANAAEPTLREAYEKHFAVGVALNTAQVTGRNKAAGELAAKQFNSITAENDMKWQSLHPELDTYRFESADAYIDFAKKNEMEVIGHTLVWHSQTPQWVFQGDDGKPATREELLKRMRDHIHKVAGRYKGKVKGWDVVNEALSDGGQDILRESPWRRIIGDDFIDHAFRYAREADPKAELYYNDYNLEIPRKRENCIKLVKGMLERGVPIDGIGTQSHFQLGFPSLEDVETTIEEFGKLGLKVMITELDVDVLPRNNPGVADISQREQGSNPYTEGLPEDVQKQLTKRYEDIFKIYLKHQKTVTRVTFWGLDDGQSWLNGFPVRGRTNHPLLFDRELKPKPVLPVLIELGKKKR

SEQ ID NO: 17 - DNA, 1035 bp, Unknown
  misc_feature: Bacterial DNA
atgtcccggcacgtcatcgccctgtccgccgccgtctgcctcgcggccggcctcgccgccgcgcccgcgagcgccgagccgcgtccccggacgctcggcgaactggccaagaagcaccacaagtacttcggctcggccaccgacaaccccgagttcaccgacgccgcctatctgaagctcctcggcagcgagttcgggcagaccacccccggcaacgccatgaagtggtacgccaccgaacccgcgcccggcgtcttcgacttcaccgcgggcgacgaggtcgtggccttcgccaaggcccatcaccagaaggtccgcggccacaccctcgtctggcacagccagctccccgcctggctcaccgagcgcagctggaccgccgcggaactgcgccccgtcctcaagaatcacatccagaaggtggcccggcactacaagggcaaggtcatccactgggacgtcgtcaacgaggccttcaacgaggacggcacctaccgcgagtcggtcttctacaagacgctcggccccggctacatcgccgacgccctgcgctgggcccacgaggccgacccgcacgccaagctgtacctcaacgactacaacgtcgacgggatcggccccaagagcgacgcctactaccgcctgatcaagcagctgaaggccgacggcgtcccggtggagggcttcggcatccaggggcacctggcgctccagtacggcttccccgccgacgtcaagcagaacatgcagcgcttcgccgacctcggcgtcgaggtcgcggtcaccgagctcgacatccggatgaacctcccggcgaccccttcgatgctcgccacccaggccacctggtacgccgactacgtcaaggcctgcctggaggtcaggaagtgcgtcggcgtcaccatctgggactacaccgacaagtactcgtggatcccctccgtcttccccggtgagggcgccgcgctgccctacgacgagaacctggcgcccaagcccgcctaccacgcgatcaggaaggtgctgggcggatga

SEQ ID NO: 18 - protein, 344 aa, Unknown
  DOMAIN (1)...(344): Bacterial protein
  SIGNAL (1)...(31)
MSRHVIALSAAVCLAAGLAAAPASAEPRPRTLGELAKKHHKYFGSATDNPEFTDAAYLKLLGSEFGQTTPGNAMKWYATEPAPGVFDFTAGDEVVAFAKAHHQKVRGHTLVWHSQLPAWLTERSWTAAELRPVLKNHIQKVARHYKGKVIHWDVVNEAFNEDGTYRESVFYKTLGPGYIADALRWAHEADPHAKLYLNDYNVDGIGPKSDAYYRLIKQLKADGVPVEGFGIQGHLALQYGFPADVKQNMQRFADLGVEVAVTELDIRMNLPATPSMLATQATWYADYVKACLEVRKCVGVTIWDYTDKYSWIPSVFPGEGAALPYDENLAPKPAYHAIRKVLGG

SEQ ID NO: 19 - DNA, 1152 bp, Unknown
  Obtained from an environmental sample
atgaagatgttaaaaactattgttgtggctgtagcagccttactatccagtcctactgcttcagccactttacagaacctgaagcgggctcctgattcattgaccttgaaagatgcatttgagggtaagttttatataggaacagcattaaaccttgatcagatatgggagcgcgatcaggctgcggtcgcggtggtcaaaacgcagttcaactccatagttgctgagaattgtatgaaaagtatgtttttgcaaccaagggaaggtgagtttgattttagggatgcggaccgttttgtcgcgtttggagaaaaaaataaaatgcaaattatcggtcatacgctgatttggcattcgcagacaccagcttggttttttgtcgataaaaatgggaaagaggtcacccgagaggtacttatcgagcgcatgcggaagcatatacaaaccgttgtttcccgctataagggaagggtgtttggttgggatgtggtgaacgaagccatattggataatggagaatggcgtaaaagcaaattctaccagattatcgggccacaatttattgaattggccttcaaatttgcgcatgacgcagatccaaatgcagaattatattataacgattattcaactgctatccccgaaaaaagaaaggggattatgcgcatggtgcagcaggtaaaggctgccggtgggcaggtcactggaattggtatgcaggaacacaacgcattggacaatccaccggtcgatgaagtcgaaaaaaccatactcggatttgcaagccttggtgcgaaggtaatggttacggaaatggatatttcggtcctgccgcatgtacgtcccaatatgggcgcagaaataggggagcgtcatgcctacagtaaagcgatgaatccgtacgaaaaaggacttcctgtaacgaaaatgaacgagttgggagcgagatatgtagcgttttttaatttatatctcaaacatcgggataaaatatcgcgtgtgacattgtggggtgttggcgatggagattcatggaagaatggttggcctattcccggacgtacagactatccattgttattcgatcggaattaccaacccaaaccttttgtaaaagatattattgcgttgactcaaaaaaaaaagaaataa

SEQ ID NO: 20 - protein, 383 aa, Unknown
  Obtained from an environmental sample
  SIGNAL (1)...(29)
MKMLKTIVVAVAALLSSPTASATLQNLKRAPDSLTLKDAFEGKFYIGTALNLDQIWERDQAAVAVVKTQFNSIVAENCMKSMFLQPREGEFDFRDADRFVAFGEKNKMQIIGHTLIWHSQTPAWFFVDKNGKEVTREVLIERMRKHIQTVVSRYKGRVFGWDVVNEAILDNGEWRKSKFYQIIGPQFIELAFKFAHDADPNAELYYNDYSTAIPEKRKGIMRMVQQVKAAGGQVTGIGMQEHNALDNPPVDEVEKTILGFASLGAKVMVTEMDISVLPHVRPNMGAEIGERHAYSKAMNPYEKGLPVTKMNELGARYVAFFNLYLKHRDKISRVTLWGVGDGDSWKNGWPIPGRTDYPLLFDRNYQPKPFVKDIIALTQKKKK

SEQ ID NO: 21 - DNA, 1119 bp, Unknown
  Obtained from an environmental sample
atgcggattcactggctggggctcagctcacgcgcaagcctgatgacggcggcgctcctggctgtcacaggcaccaccaaatccgaggactcgcccgcaactttgaaagacgccttcaaggattgtttccggatcggggtcgcgctcaaccagcggcaatttaccgagcaagataccaacggcgcgacgttggtgaaacggcagttcaacgccatctcacccgaaaacgtgatgaagtgggcgaacattcatccccgacccgggcccgatgggtataacttcgaggcggctgaccgttacgtcgagtttggcgagaagaacggaatgttcatcgtcggccatacgctcgtttggcacttccaaacgccgcgctgggtactccagggcgatggcactaacgcggcgacgcgcgagctgctgctgcagcggatgcgcgatcacatccacacggtcgtaggccggtacaaagggcggatcaaggcttgggacgtggtcaacgaagcgctgaacgaagatggcactctgcggcggtcgcagtggtaccggatcatcggcgaagactacatcgtcaaggctttcgaatatgcgcatgaggccgatccgtccgcggaattgcgatacaacgattacgccatcgagaatgagcggaagcgcgacggcgtaatcgcgctcgtgaagaaacttcaggcgcagaaggtcccacttggggggctgggctcgcagacgcatgccaacctgacctggcctaacgccgaatcgctggacaccgccctcacggccttcaccgaactgggtatcccgatctcaatcacggaactggatgtgaccgcctcgcaacgcggtcagctcaaccagagcgccgaggtgtcgcagaatggacaggcgggggagggaggcgtggtggacggggcgaatcagaagctcgccgagcagtacgccaacttcttccgcgtctttctgaagcatcgcaaaaacattgagctcgtgacgttttggggcgtcacggatcgtgactcctggcggcgcattggcaaaccgctgctatttaacgcagaatggcaacccaagccggcctttcacgccgtcatcgccgaggcgaaaaagatcagtgggcaatga

SEQ ID NO: 22 - protein, 372 aa, Unknown
  Obtained from an environmental sample
  SIGNAL (1)...(28)
MRIHWLGLSSRASLMTAALLAVTGTTKSEDSPATLKDAFKDCFRIGVALNQRQFTEQDTNGATLVKRQFNAISPENVMKWANIHPRPGPDGYNFEAADRYVEFGEKNGMFIVGHTLVWHFQTPRWVLQGDGTNAATRELLLQRMRDHIHTVVGRYKGRIKAWDVVNEALNEDGTLRRSQWYRIIGEDYIVKAFEYAHEADPSAELRYNDYAIENERKRDGVIALVKKLQAQKVPLGGLGSQTHANLTWPNAESLDTALTAFTELGIPISITELDVTASQRGQLNQSAEVSQNGQAGEGGVVDGANQKLAEQYANFFRVFLKHRKNIELVTFWGVTDRDSWRRIGKPLLFNAEWQPKPAFHAVIAEAKKISGQ

SEQ ID NO: 23 - DNA, 1137 bp, Unknown
  Obtained from an environmental sample
atgaggacaaaacaagtttttaaattaaccacgctcgctttattattaacagcagttgttagtagctgttctgccccaaaagcggcaaaagaagatacgcttaaagatgccctccagggaaaattctttattggtgctgctgttaatgttgaccaaatggcaggaaaggattctcttgcaattgaagttgttaaaaagaactttagctcaattgtggccgagaattgcatgaaaatggaaaacatccatcctgtaaaaggtgaatttttcttcgatgaagccgatgcatatgttgaatttggcgaaaaaaacaacatgaaaatcattggtcacacattgatttggcattcacaagccgccaaatgggcatttgttgatgatgaaggcaaagatgtatcgcgcgaagaattaattgaacggatgcgcaaccacatccataccattgtaggccgctataaaggtcgtgtacatggctgggacgttgttaatgaggctattctggataacggcgaatggcgtcagagcaaatggtataccattattggacccgaatttgttcagcttgcttttgagtttgcccacgaagccgaccccaacgctgaattgtattacaacgactacaacgagtggattccggctaaaagagacggcatttacaacatggttaaggatttaatcgacaaaggcgttaaagttgatggaattggcctacagggtcacattgctcttgactctcccagcatcgaactttacgaagaagccattgtaaaatatgcaagtctgggtgtgcaaacaatggttaccgaactcgatatcactgttttaccatggccatcgcagcaagttacagccgatatatcttttagtgcagagctatcaaccgaatacaatccatttgttaatggtttacccgattcggttagcgttgaacttaccaaccgttttgccagtttcttcgagttgtttttgaaacatcaggataaaattgaccgcgttactctatggggtgtacacgatggtcaatcatggaaaaacaactggcccatcaggggacgtaaagattatccgttgttattcgacaggcaatatcagtccaaacctgccgttcagcgcataatcgaattggctaaacaataa

SEQ ID NO: 24 - protein, 378 aa, Unknown
  Obtained from an environmental sample
  SIGNAL (1)...(29)
MRTKQVFKLTTLALLLTAVVSSCSAPKAAKEDTLKDALQGKFFIGAAVNVDQMAGKDSLAIEVVKKNFSSIVAENCMKMENIHPVKGEFFFDEADAYVEFGEKNNMKIIGHTLIWHSQAAKWAFVDDEGKDVSREELIERMRNHIHTIVGRYKGRVHGWDVVNEAILDNGEWRQSKWYTIIGPEFVQLAFEFAHEADPNAELYYNDYNEWIPAKRDGIYNMVKDLIDKGVKVDGIGLQGHIALDSPSIELYEEAIVKYASLGVQTMVTELDITVLPWPSQQVTADISFSAELSTEYNPFVNGLPDSVSVELTNRFASFFELFLKHQDKIDRVTLWGVHDGQSWKNNWPIRGRKDYPLLFDRQYQSKPAVQRIIELAKQ

SEQ ID NO: 25 - DNA, 978 bp, Unknown
  Obtained from an environmental sample
gtggatccaaagaattccttacgcgccttagctcaaaagcgaggaattgggtttgggacggcagtttgggttgagcctctgtctaacgattcgagatatcggacggtgttggcgcaggagttcaatatggtgacgccagagaatgagatgaagtttgagccgacgcatccagaacgggagcgctacgattttacagcagccgatacccttgttgactttgccaagaaccataacatgcaggtgcgcggacataccctggtttggcatgaaagtctccccgattggctaacgactcaaacgtggacgcgtgaggagttgatgtccatcttagaagaacacatcaatacagttgtcgatcgctatcgggggcaattagttgcctgggatgtggtgaatgaagcgatcgccaacgataaaaacgcactcagagatacgatttggctgcgaacaatcgggccagagtatatagagaaggcatttcgctgggcgcatgcagccgaccctcaagcacgtttattttacaacgattatggcggcgaggaagtggggggaaagtctgaggccatctatggcatgcttaaagatttgctgcaacagggtgtcccgattcacggggttggcttgcaaatgcacgttagtataaaaaaccctcccaatcccgaaaaagtggcggcaaatatcaagcgcctgaacgatctgggattggaagtgcatataactgagatggatgtgaaaacctgggatggcatcggtacgaagcagcaacgacttgcggctcaggcacaagtgtatcggaacatgatgcaggtgtgtttggaagctgagaactgtaaggcgttttcgttgtggggggtaagcgatcgctattcttggattccccggatttttaagaagccggatgcaccactgatttttgatgatttagggcgtccgaaacccgcttacaatgccctgaaagaagtcctcaagcggcgttaa

SEQ ID NO: 26 - protein, 325 aa, Unknown
  Obtained from an environmental sample
VDPKNSLRALAQKRGIGFGTAVWVEPLSNDSRYRTVLAQEFNMVTPENEMKFEPTHPERERYDFTAADTLVDFAKNHNMQVRGHTLVWHESLPDWLTTQTWTREELMSILEEHINTVVDRYRGQLVAWDVVNEAIANDKNALRDTIWLRTIGPEYIEKAFRWAHAADPQARLFYNDYGGEEVGGKSEAIYGMLKDLLQQGVPIHGVGLQMHVSIKNPPNPEKVAANIKRLNDLGLEVHITEMDVKTWDGIGTKQQRLAAQAQVYRNMMQVCLEAENCKAFSLWGVSDRYSWIPRIFKKPDAPLIFDDLGRPKPAYNALKEVLKRR

SEQ ID NO: 27 - DNA, 1173 bp, Unknown
  Obtained from an environmental sample
atgaaatccttaacaaatcaatccttcatgaaactcataatctgtctggcattgccagtcgcactactcagcatttcatgcaaaaaacccgccgaaccactgaaaccggttgaaggcttaaaagacagcttcaaagacaagtttctcatgggtgtggcgctgaataaagcacagattctgggaagagatacattggtacatgcttttacagtacagcattttaattccattactgcagaaaacgaaatgaagtgggaacgcatccacccgcagcctgatgtatatgatttcacggttccggacagcctgattgcttttggcgaacgcaacggcatgtttatagtcgggcatacactcgtatggcactcccaggtgcccgattgggttttcaccgatgagaagggaaagcctctgacccgcgatgctctgctccaacgcatgaaggatcatatttatgccgttgtcggccggtataagggcaaggtggatggctgggatgtggtaaatgaagcattggatgaagacggacagctgcgcaaatccaggtggcatgaaatcatcggtgatgattacattcagaaagcctttgagttcacccgggaggcagatcccggtgcagagctttattacaatgattacaacatagaactcaaaaaaaagcgggagggtgctgtcaggctgctacaggaactgcagcaaaaaggcattaaaatcgacggagtgggcattcagggacattggcacctgcactcacctgatctgcaagagattgattcaagtcttcaggcatacggacaacttggtctgaaggtcatgatcaccgaactggatgttaacgtcattcccgaaccttcaggtattattggcgccgatgttgcacagcgggcggattatcagagccagctgaatccatggcctgaaagttttcccgattccatgcagcaggttctggccagccggtatgccgaactgttcggattgttcctgaagcacagcgataaggtaagccgggtgaccttctggggaattcacgatggctattcctggaagaacaactggccaataccgggccgaacaacttatcccctcctttttgaccggaattaccagcctaaacctgcgtatgatgctgtcattgaattgaccaaaatacagccggaagccagtaactga

SEQ ID NO: 28 - protein, 390 aa, Unknown
  Obtained from an environmental sample
  SIGNAL (1)...(27)
MKSLTNQSFMKLIICLALPVALLSISCKKPAEPLKPVEGLKDSFKDKFLMGVALNKAQILGRDTLVHAFTVQHFNSITAENEMKWERIHPQPDVYDFTVPDSLIAFGERNGMFIVGHTLVWHSQVPDWVFTDEKGKPLTRDALLQRMKDHIYAVVGRYKGKVDGWDVVNEALDEDGQLRKSRWHEIIGDDYIQKAFEFTREADPGAELYYNDYNIELKKKREGAVRLLQELQQKGIKIDGVGIQGHWHLHSPDLQEIDSSLQAYGQLGLKVMITELDVNVIPEPSGIIGADVAQRADYQSQLNPWPESFPDSMQQVLASRYAELFGLFLKHSDKVSRVTFWGIHDGYSWKNNWPIPGRTTYPLLFDRNYQPKPAYDAVIELTKIQPEASN

SEQ ID NO: 29 - DNA, 2331 bp, Archaea
atgacgatgcagagaaagtactcatccgacgcgaacacacagtatgagtggataaaatcagctactgtaccatctggtcagtgggtacagctctctggaacgtacacgatcccggccggagttaccgtggaagatctcacgctttacttcgaatctcaaaatccaacccttgagttctacgtggatgacgtgaagatagtggatacaacttccgcagagataaagattgaaatggaacctgaaaaagagatacctgctctgaaagaagtactgaaagattacttcaaagtcggagttgcactgccgtccaaggtcttcctcaacccgaaggacatagaactcatcacgaaacacttcaacagcatcaccgcagaaaacgagatgaaaccggatagtctgctcgcgggcatcgaaaacggtaagctgaagttcaggtttgaaacagcagacaaatacattcagttcgtcgaggaaaacggcatggttataagaggtcacacactggtgtggcacaaccagacacccgactggttcttcaaagacgaaaacggaaacctcctctccaaagaagcgatgacggaaagactcaaagagtacatccacaccgttgtcggacacttcaaaggaaaagtctacgcatgggacgtggtgaacgaagcggtcgatccgaaccagccggatggactgagaagatcaacctggtaccagatcatggggcctgactacatagaactcgccttcaagttcgcaagagaggcagatccagatgcaaaactcttctacaacgactacaacacattcgatcccagaaagagagacatcatctacaacctcgtgaaggatctcaaagagaagggactcatcgatggcataggaatgcagtgtcacatcagtcttgcaacagacatcaaacagatcgaagaggccatcaaaaagttcagcaccatacccggtatagaaattcacatcacagaactcgatatgagtgtctacagagattccagttccaactacccagaggcaccgaggacggcactcatcgaacaggctcacaaaatgatgcagctctttgagatcttcaagaagcacagcaacgtgatcacgaacgtcacattctggggtctcaaggacgattactcctggagagcaacaagaagaaacgactggccgctcatcttcgacaaagatcaccaggcgaaactcgcttactgggcgatagtggcacctgaggtccttccaccacttccaaaagaaagcaggatctccgaaggcgaagcagtggtagtggggatgatggacgactcgtacctgatgtcgaagccgatagagatccttgacgaagaagggaacgtgaaggcaacgatcagggcagtgtggaaagacagcacgatctacatctacggagaggtacaggacaagacaaagaaaccagcagaagacggagtggccatattcatcaacccgaacaacgaaagaacaccctatctgcagcctgatgacacctacgttgtgctgtggacgaactggaagacggaggtcaacagagaagacgtacaggtgaagaaattcgttgggcctggctttagaagatacagcttcgagatgtcgatcacgataccgggtgtggagttcaagaaagacagctacataggatttgacgttgcggtgatagacgacgggaagtggtacagctggagcgacacgacgaacagccagaagacgaacacgatgaactacggaacgctgaagctcgaaggaataatggtagcgacagcaaaatacggaacaccggtcatcgatggagagatcgatgagatctggaacacgacagaggagatagagacgaaagcggtggctatgggatcgcttgacaagaatgcgacagcgaaagtgagggtgctgtgggacgagaactacctgtacgtacttgcgatcgtgaaagagcccgttctgaacaaagacaacagcaacccgtgggagcaggattccgtggagatcttcgtggatgagaacaaccacaagacaggatactacgaagacgacgacgcgcagttcagggtgaactacatgaacgagcagacctttggaacgggaggaagtccagcgaggttcaagacagcggtgaagctgatcgaaggaggatacatagttgaggcagcgatcaagtggaagacgatcaagccaacaccgaacacagtgataggattcaacatccaggtgaacgatgcgaacgagaaagggcagagggtcggtatcatctcctggagcgatcccacaaacaacagctggcaagatccttcaaagttcggtaacctcagactcatcaagtga

SEQ ID NO: 30 - protein, 776 aa, Archaea
MTMQRKYSSDANTQYEWIKSATVPSGQWVQLSGTYTIPAGVTVEDLTLYFESQNPTLEFYVDDVKIVDTTSAEIKIEMEPEKEIPALKEVLKDYFKVGVALPSKVFLNPKDIELITKHFNSITAENEMKPDSLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFDPRKRDIIYNLVKDLKEKGLIDGIGMQCHISLATDIKQIEEAIKKFSTIPGIEIHITELDMSVYRDSSSNYPEAPRTALIEQAHKMMQLFEIFKKHSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYVVLWTNWKTEVNREDVQVKKFVGPGFRRYSFEMSITIPGVEFKKDSYIGFDVAVIDDGKWYSWSDTTNSQKTNTMNYGTLKLEGIMVATAKYGTPVIDGEIDEIWNTTEEIETKAVAMGSLDKNATAKVRVLWDENYLYVLAIVKEPVLNKDNSNPWEQDSVEIFVDENNHKTGYYEDDDAQFRVNYMNEQTFGTGGSPARFKTAVKLIEGGYIVEAAIKWKTIKPTPNTVIGFNIQVNDANEKGQRVGIISWSDPTNNSWQDPSKFGNLRLIK

SEQ ID NO: 31 - DNA, 1134 bp, Unknown
  Obtained from an environmental sample
gtggaaaccgtcggagcaccggagctgagctatgaaatccggaatttccgggtggtggcaccggacggagtgccggatatacagcccacagccgcaccggaagcgcaggctgttccggaaggggagatgccttccctgaaggatgtatacgcgggcaaattcgacttcggtacggcgctgccccggaatgcattcaatgatatccagctgctgagactggtgaaggaccagttcaacatcctgacaccggaaaatgagatgaaaccggatgcaatcctggatgtgtacggcagcaaaaaactggcggaaaaggacgagacagcggtggctgtccggtttgaagcatgcaagacgctgcttcggttcgcacagtccaacggcctgaaggtgcacggccatacgctgctgtggcacaaccagaccccggaagcccttttccacgaaggttatgacaccaccaagccgatggccggccgggaagtgatgttgggccggatggagaattacatccgcgaagtgctgacctggaccgaagaaaattatccgggcgtgatcgtttcctgggacgtggtgaatgaagcaatcgacgacggaacgaaccagctgcgcaccggtgccaactggtataagacggtcggaccggactacctggcacgcgcgtttgaatatgcccggaaatacgcggcggaaggcgtgctgctgtactacaacgattacaataccgcatacggcggtaagctgtatgggattgtggatctgctggagagcctgattgccgagggcaatattgacggatacggattccagatgcaccacagcctgggagaaccttccatggatatgattacccgggcagtagagaaaatagcctcgctgggactccggctgcgtgtgagcgaactggacatcaacgccggcaaggcgacagagaaaaatttcgaagcccagaagaacaagtacaaacaggtgatgaagctgatgctccggttcaaggaccagactgaagcggtccaggtgtggggcgtgacggacatcatgagctggcgcagggacggatatccgctgctgtttgacaagaacatgaatccgaaacccgcgttcttcggtgtgatcgaagccggaatggaagactga

SEQ ID NO: 32 - protein, 377 aa, Unknown
  Obtained from an environmental sample
VETVGAPELSYEIRNFRVVAPDGVPDIQPTAAPEAQAVPEGEMPSLKDVYAGKFDFGTALPRNAFNDIQLLRLVKDQFNILTPENEMKPDAILDVYGSKKLAEKDETAVAVRFEACKTLLRFAQSNGLKVHGHTLLWHNQTPEALFHEGYDTTKPMAGREVMLGRMENYIREVLTWTEENYPGVIVSWDVVNEAIDDGTNQLRTGANWYKTVGPDYLARAFEYARKYAAEGVLLYYNDYNTAYGGKLYGIVDLLESLIAEGNIDGYGFQMHHSLGEPSMDMITRAVEKIASLGLRLRVSELDINAGKATEKNFEAQKNKYKQVMKLMLRFKDQTEAVQVWGVTDIMSWRRDGYPLLFDKNMNPKPAFFGVIEAGMED

SEQ ID NO: 33 - DNA, 1815 bp, Unknown
  Obtained from an environmental sample
atggttcgcaaaaaactattttatatcgtcgcgttaatgctgatgttcggcgcaagttttacttccgctcaggacgcggaattttccctgcgcggtttagccgagcgcaataacttttatgttggagcagccgtttataccactcatctgaatgatcctgtccatgttgaaacactggcacgagaattcaatatgctcacgcctgaacagcaggccaaacattgtgagttggaggcacagcaaggtcaatttgactttcggagtttcgatcgtttagtcgccttcgccgaagaacacaacatggcgatacacggtcatgcgctggtctggcatagctgcacaccgcaatgggtggctaacggcgagtacacccgtgacgaagccattggtctgctgcgcgactcgattatgaccattgttggccgttacaaaggccgtattccgatttgggacgtcgtcaatgaaggcattgctgacagcggcggaacactgcgcgatacgccatggcggcagttaattggcgatgattacatcgaacttgccttccagttcgctcatgaagccgacccggatgcgctgctgttttacaacgactataatacggaaggcatgaaccctaaatcggacgccatgtacgagatggtgagcgattttgtggcgcgtggaattccgattcacggggttgggctgcaatcccatttcatattaggcagttttgacccagaccagattgctcggaacgtcgcgcggcttggcgaactcggtttacaagttcaattcaccgaggtcgatattcgatattccggcgaggcgacagataatatcctccagcggcaggcgggcgattaccatcgcctgatggacgtttgcctcggtaacgacgcctgtactgcgtttatcacctggggcgtgaccgataaatatacctggttgcggggcgcgaacctgggcttctacaacaacctatcggttgaaccgctgctttttgacgatgactatgaacccaagcccgcttattttgcggtgctggactcactagcgcgaagagcgggcgaaacccccgttttgagcgatgacgagcttgcggcgatgatcggcggcacagtccaaacggtcgaaattcccccgccgacgaaaagcaatctcagtcaggaagcgccggacgccgttcctggtgtgatctattacgccgcctaccccataagcatcacagttgacggcgaagccaacgattgggaacgcattccgcgcggtatgattgacagcggccccaccgtacctcaggataacgacacgacaatgacatttgccgccgctgccgacaaaaccaatctatacttccttgcagaggttacggacagccaggtgtcctacggaacgcacgacccggctactgcctggtatcaggaggactcggttgagttttacctgaacacgacaggcgatctaactaacaccgcctaccaacccggcgtcgcccaaatcggtatcatggcagccaacatcgacaacgataatcccggtgcaccgatcatcgggggcggcaacagcgacatttcgcaggtaaaagcgattgtcgtcaaaaccgataccgggtatctggtcgaggcgtctgttccactcatgaccgatgtctggacgattgaaccgaaacaaggggctgtactcggcttccaagtgcatctcaatggctcacgcacaccggatgccgaccgagacaccaagttgatctggtcgctactggatacgctagatcagtcctatagcaatcccagcctgtttggccgactcatcttctggaacataaatctctaa

SEQ ID NO: 34 - protein, 604 aa, Unknown
  Obtained from an environmental sample
  SIGNAL (1)...(23)
MVRKKLFYIVALMLMFGASFTSAQDAEFSLRGLAERNNFYVGAAVYTTHLNDPVHVETLAREFNMLTPEQQAKHCELEAQQGQFDFRSFDRLVAFAEEHNMAIHGHALVWHSCTPQWVANGEYTRDEAIGLLRDSIMTIVGRYKGRIPIWDVVNEGIADSGGTLRDTPWRQLIGDDYIELAFQFAHEADPDALLFYNDYNTEGMNPKSDAMYEMVSDFVARGIPIHGVGLQSHFILGSFDPDQIARNVARLGELGLQVQFTEVDIRYSGEATDNILQRQAGDYHRLMDVCLGNDACTAFITWGVTDKYTWLRGANLGFYNNLSVEPLLFDDDYEPKPAYFAVLDSLARRAGETPVLSDDELAAMIGGTVQTVEIPPPTKSNLSQEAPDAVPGVIYYAAYPISITVDGEANDWERIPRGMIDSGPTVPQDNDTTMTFAAAADKTNLYFLAEVTDSQVSYGTHDPATAWYQEDSVEFYLNTTGDLTNTAYQPGVAQIGIMAANIDNDNPGAPIIGGGNSDISQVKAIVVKTDTGYLVEASVPLMTDVWTIEPKQGAVLGFQVHLNGSRTPDADRDTKLIWSLLDTLDQSYSNPSLFGRLIFWNINL

SEQ ID NO: 35 - DNA, 2286 bp, Unknown
  Obtained from an environmental sample
atgaccttgattacgccaagctcgaaattaaccctcactaaagggaacaaaagctggagctcgcgcgcctgcaggtcgacactagtggatctcacgctttacttcgaatctcaaaatccaacccttgagttctacgtggatgacgtgaagatagtggatacaacttccgcagagataaagattgaaatggaacctgaaaaagagatacctgctctgaaagaagtactgaaagattacttcaaagtcggagttgcactgccgtccaaggtcttcctcaacccgaaggacatagaactcatcacgaaacacttcaacagcatcaccgcagaaaacgagatgaaaccggatagtctgctcgcgggcatcgaaaacggtaagctgaagttcaggtttgaaacagcagacaaatacattcagttcgtcgaggaaaacggcatggttataagaggtcacacactggtgtggcacaaccagacacccgactggttcttcaaagacgaaaacggaaacctcctctccaaagaagcgatgacggaaagactcaaagagtacatccacaccgttgtcggacacttcaaaggaaaagtctacgcatgggacgtggtgaacgaagcggtcgatccgaaccagccggatggactgagaagatcaacctggtaccagatcatggggcctgactacatagaactcgccttcaagttcgcaagagaggcagatccagatgcaaaactcttctacaacgactacaacacattcgatcccagaaagagagacatcatctacaacctcgtgaaggatctcaaagagaagggactcatcgatggcataggaatgcagtgtcacatcagtcttgcaacagacatcaaacagatcgaagaggccatcaaaaagttcagcaccatacccggtatagaaattcacatcacagaactcgatatgagtgtctacagagattccagttccaactacccagaggcaccgaggacggcactcatcgaacaggctcacaaaatgatgcagctctttgagatcttcaagaagcacagcaacgtgatcacgaacgtcacattctggggtctcaaggacgattactcctggagagcaacaagaagaaacgactggccgctcatcttcgacaaagatcaccaggcgaaactcgcttactgggcgatagtggcacctgaggtccttccaccacttccaaaagaaagcaggatctccgaaggcgaagcagtggtagtggggatgatggacgactcgtacctgatgtcgaagccgatagagatccttgacgaagaagggaacgtgaaggcaacgatcagggcagtgtggaaagacagcacgatctacatctacggagaggtacaggacaagacaaagaaaccagcagaagacggagtggccatattcatcaacccgaacaacgaaagaacaccctatctgcagcctgatgacacctacgttgtgctgtggacgaactggaagacggaggtcaacagagaagacgtacaggtgaagaaattcgttgggcctggctttagaagatacagcttcgagatgtcgatcacgataccgggtgtggagttcaagaaagacagctacataggatttgacgttgcggtgatagacgacgggaagtggtacagctggagcgacacgacgaacagccagaagacgaacacgatgaactacggaacgctgaagctcgaaggaataatggtagcgacagcaaaatacggaacaccggtcatcgatggagagatcgatgagatctggaacacgacagaggagatagagacgaaagcggtggctatgggatcgcttgacaagaatgcgacagcgaaagtgagggtgctgtgggacgagaactacctgtacgtacttgcgatcgtgaaagatcccgttctgaacaaagacaacagcaacccgtgggagcaggattccgtggagatcttcgtggatgagaacaaccacaagacaggatactacgaagacgacgacgcgcagttcagggtgaactacatgaacgagcagacctttggaacgggaggaagtccagcgaggttcaagacagcggtgaagctgatcgaaggaggatacatagttgaggcagcgatcaagtggaagacgatcaagccaacaccgaacacagtgataggattcaacatccaggtgaacgatgcgaacgagaaagggcagagggtcggtatcatctcctggagcgatcccacaaacaacagctggcaagatccttcaaagttcggtaacctcagactcatcaagtga

SEQ ID NO: 36 - protein, 761 aa, Unknown
  Obtained from an environmental sample
MTLITPSSKLTLTKGNKSWSSRACRSTLVDLTLYFESQNPTLEFYVDDVKIVDTTSAEIKIEMEPEKEIPALKEVLKDYFKVGVALPSKVFLNPKDIELITKHFNSITAENEMKPDSLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFDPRKRDIIYNLVKDLKEKGLIDGIGMQCHISLATDIKQIEEAIKKFSTIPGIEIHITELDMSVYRDSSSNYPEAPRTALIEQAHKMMQLFEIFKKHSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYVVLWTNWKTEVNREDVQVKKFVGPGFRRYSFEMSITIPGVEFKKDSYIGFDVAVIDDGKWYSWSDTTNSQKTNTMNYGTLKLEGIMVATAKYGTPVIDGEIDEIWNTTEEIETKAVAMGSLDKNATAKVRVLWDENYLYVLAIVKDPVLNKDNSNPWEQDSVEIFVDENNHKTGYYEDDDAQFRVNYMNEQTFGTGGSPARFKTAVKLIEGGYIVEAAIKWKTIKPTPNTVIGFNIQVNDANEKGQRVGIISWSDPTNNSWQDPSKFGNLRLIK

SEQ ID NO: 37 - DNA, 2769 bp, Unknown
  Obtained from an environmental sample
atgcacaagaagaacggcacctattacctgagctactctacaaatccggccaacggcatgcggattgactacatgaccagcacgagcccgaccagtggctttgtccatcgaggcacggtcatggcgcagccctggcagaacagcaacaacaacaaccacgcaaccagcaccgagtacaacgggcagggctacatcttctatcacaaccgtgcgttgtcgaacgagcgtgcgggtggcaacgtgctgcagcgctcggtgaacgtggatcgcctctacttcaatgccgatggcagcatccgtcaggtcacttccagtgcaaccggcgtgccggccctgaaaaccctggatgccttcctggtcaagcctgccgagctgtatcacaaggaaagcgggatcaagaccgagcctgccagtgaaggaacccaggcactggttatgacggctggtagctgggtgcgcctggccaatgtcgatttcggcaatggcggcgccactggtttttccgcgcgtattgcggcaaccggcagcggcagcatccaggtgatcctgggcaatctgaacaacgccccggtcggcacgctggcagtgagcagcaccggcaacctccagacctggcaagaccgcagcaccgccatcagcaaggtgaccggcgtgcatgacgtgtatttgcgtgccaccggcaatgtgcatgtgcagcgtcactggttcgtggcgtcggcgccggccgctgccgcctcatccagcagtcaggcaagcgtctctgccagcagtcaggcaagtgtttcttccagtagccaggcaagcgttgcctccagcagcagttccagccgcgcttcttccgccagcagttcggtggcggctggccaggtggaggtcggttatcgccttagcagcgaatgggccgccggcttctgcggcgtggtcaccatccgtaatccgggtagttctccggtcaccagctggagtggcagtttcaacctgcctggcggcaagatcacccagctgtggaatgccaactggacccagaacggcagcaccgtgacggtatcttcccaggcctggagcggtgccattgctgcaggcgccaccatcaccacgccgggcttctgcgccgagcgcacgagcagcaatgcgtcctccagtgtcgccagcagcagtgtctcctcatcgagcagcagtgctgcggctgccagctccagcgcggcttccagcgtcccgtccactggcagtggcggggtgggcagcagcgcatcctcggctagcagtgccgctgcacccaagggcgtgcttgaagtcggcctgagcggcctttccagccaggccatgttcgccccgttgcgggtcaggacggacgctgcggccgccaacaaggcctatgttgaatggcccaacaacggcgccaatcagtcgctggcaacgcctgccaacgatgccgcagggcaggtggaggtagccttcgtgctggcccaggcatccgcagtgcagtttgatatcgaagcgaatttcgccaacgcggaagacgactccttctacttccagctcaacggtggtgcctggcagaccttcaacaacgccaccacggtcggctggcagaccctgccggtcgcctctctgggcaatctggctgccgggcgccatgtgctgaccctgctgcgccgcgaggatggcgcgaagctgggcaaggtcgtcctgagtgcggcacagagcagcatcagtcgtgccacgccggtggcctacgcgtcgccgaatgatgttgccaacctgttcaagctggccagcttcccgatcggggtggcggtcagtgccggcaacgaaggtgacagcctgctgcgtagcggtacccgcgcagcagccgagcgtgcgctgaccgagaagcacttcaacagtctggtggccggcaacatcatgaagatgagctacctgcatccggccgagaacacctacaccttcacccaggcggatgcgctggccgactacgccaagtccaagggcatggtgttgcatggccatgcgctggtctggcatgcggactatcaggtacccaactggatgaagaattacaccggagactggtcgaagatgctcgaagcccacgtcaccaccgtcgccaagcactatgccggcaaggtggtgagctgggatgtggtgaatgaagccctggccgatggcaatgccaccgccaccaagggtttccgtgccaccgattcgatcttctatcagaagatgggctccagtttcatcgagaaggcctttattgctgcacgtgctgccgacccgaatgccgacctgtattacaacgactacggcatggagggcggaaacagcaagttcaattactgcatggccatggtcgatgatttccagaagcgtggcattcccatcgacggcatcggtttccagatgcacatcaacatcgactggccttcgtcggcccagatccgcgctgtattcagtgaagtggtcaagcgtggtctgaaggtgcgtatctccgagctggatattccggtgaataccactgccggtcgttttgccagcctgaatgccacggccaacgagctgcagaagaagaagtatcgtgaggttgtggctgcctacctggatgtggtgccgcccgagctgcgcggtggcatcaccgtgtggggcctgagcgacaacggcagctggctggtgacccccaccaagccggactggccgctgctgttcgatgccgacctcaaggccaaggacgccctgagcggctttgccgacgccctgcgcggcgtacgctga

SEQ ID NO: 38 - protein, 922 aa, Unknown
  Obtained from an environmental sample
MHKKNGTYYLSYSTNPANGMRIDYMTSTSPTSGFVHRGTVMAQPWQNSNNNNHATSTEYNGQGYIFYHNRALSNERAGGNVLQRSVNVDRLYFNADGSIRQVTSSATGVPALKTLDAFLVKPAELYHKESGIKTEPASEGTQALVMTAGSWVRLANVDFGNGGATGFSARIAATGSGSIQVILGNLNNAPVGTLAVSSTGNLQTWQDRSTAISKVTGVHDVYLRATGNVHVQRHWFVASAPAAAASSSSQASVSASSQASVSSSSQASVASSSSSSRASSASSSVAAGQVEVGYRLSSEWAAGFCGVVTIRNPGSSPVTSWSGSFNLPGGKITQLWNANWTQNGSTVTVSSQAWSGAIAAGATITTPGFCAERTSSNASSSVASSSVSSSSSSAAAASSSAASSVPSTGSGGVGSSASSASSAAAPKGVLEVGLSGLSSQAMFAPLRVRTDAAAANKAYVEWPNNGANQSLATPANDAAGQVEVAFVLAQASAVQFDIEANFANAEDDSFYFQLNGGAWQTFNNATTVGWQTLPVASLGNLAAGRHVLTLLRREDGAKLGKVVLSAAQSSISRATPVAYASPNDVANLFKLASFPIGVAVSAGNEGDSLLRSGTRAAAERALTEKHFNSLVAGNIMKMSYLHPAENTYTFTQADALADYAKSKGMVLHGHALVWHADYQVPNWMKNYTGDWSKMLEAHVTTVAKHYAGKVVSWDVVNEALADGNATATKGFRATDSIFYQKMGSSFIEKAFIAARAADPNADLYYNDYGMEGGNSKFNYCMAMVDDFQKRGIPIDGIGFQMHINIDWPSSAQIRAVFSEVVKRGLKVRISELDIPVNTTAGRFASLNATANELQKKKYREVVAAYLDVVPPELRGGITVWGLSDNGSWLVTPTKPDWPLLFDADLKAKDALSGFADALRGVR

SEQ ID NO: 39 - DNA, 1143 bp, Unknown
  Obtained from an environmental sample
atgaaaaaaacgattgcacatttcaccttatggatagtgttttttctcttcacttcctgtgctgttacggcgcagaagaatgcaaagaatacaagagtaaaacccactaccctaaaagaggcttaccaaggtaaattctatatcggtactgcgatgaacttgagacagattcacggagatgatccccaatctgaaaatattatcaaaaaacagttcaattccatagttgccgaaaactgcatgaagagtatgtatcttcagccggaggaaggaaaatttttcttcgatgatgcggacaagtttgtggattttggtcttcagaacaatatgttcatcattgggcattgtctgatttggcattcgcaggcgccaaaatggtttttcaccgatgagaatggaaacacggtttctccagaagttcttaaacaaaggatgaaagcccatattaccgccgtcgtttcccgttacaaagggaaaatcaaaggttgggatgtggtgaacgaagccattatggaagatggttcttaccgtaaaagcaaattttacgagattttgggagaagaatttattccgttggcatttcagtatgcgcatgaagcagatcctgatgcagaactttattacaacgattataacgaatggtatcccggaaaaagagctacggtgaccaagataatccgcgatttcaaaactagaggaatccgcatcgatgccatcggaatgcaggctcatttcgggatggattcgcccactgtagaagagtatgaacaaactattcagggctatataaaagaaggcgtgaaagtcaatattacggaactcgatttgagtccacttccttctccttggggaacttccgccaatgttgccgatacgcagcaatatcaggaaaaaatgaatccatacaccaaaggacttcctgcagatgttgaaaaagcatgggaaaaccgttatgtggattttttcaaactgttcctaaaatatcatcagcatattgagcgtgttacgttttggggcgttagcgatatcgattcctggaagaacgattttccggtaagaggacgtaccgattatccactaccgtttaaccgtcaatatcaagcaaaacctttggttcagaaattaatagatttaacaaaatag

SEQ ID NO: 40 - protein, 380 aa, Unknown
  Obtained from an environmental sample
  SIGNAL (1)...(24)
MKKTIAHFTLWIVFFLFTSCAVTAQKNAKNTRVKPTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGNTVSPEVLKQRMKAHITAVVSRYKGKIKGWDVVNEAIMEDGSYRKSKFYEILGEEFIPLAFQYAHEADPDAELYYNDYNEWYPGKRATVTKIIRDFKTRGIRIDAIGMQAHFGMDSPTVEEYEQTIQGYIKEGVKVNITELDLSPLPSPWGTSANVADTQQYQEKMNPYTKGLPADVEKAWENRYVDFFKLFLKYHQHIERVTFWGVSDIDSWKNDFPVRGRTDYPLPFNRQYQAKPLVQKLIDLTK

SEQ ID NO: 41 - DNA, 1893 bp, Unknown
  Obtained from an environmental sample
atgatccatcaacaaaagcccaaccaagacatcggtaggctattcaagcgcagctgcagctttgtcggtattagcgcggcactggctgttttctcacacaccgcaagtgcagcctgtacttacaacattgataaccaatggggcagcggttttgtcgctagtattactgtaaagaatgacactggtgcaaccgtcaataactggagtgtgaattggcaatatgccaacaatcgcatcaccaatggttggagtgcaaatttctctggcagcaatccttacaccgccaccaatatgagctggaacggtagcattgccgctggccagtcggtgacttttggtttccagggcaacactaacagcaataccgttgagcgcccggtggttaacggttcactgtgcggtactgcaacaacctcttcagttcgctccagcgtggctgcgacgtcttccagtcgctccagtgttgcgcccagctcgattcctgcttccagcactccgcgttcaagcacacctgccacctcttcttctgcttccagcttctcagtaccggccaataattttgcgcagaatggcggcgtggaatctggtttgaccaactggggtacgactgcgggcaccgtgactcgctctactgccgataaacacagcggtacagccagtgccttaattaccggccgcactgctgcctggaatggtttgacgtttaatgtgggcgcattgaccaacggcaaccagtaccaagtcaacgtgtgggtgaaattggctccaggtacgcccgacagcgtactgaccttaaccggtaagcgtgtagacgatagcgatactactacctacaacgaatacacacgcgtagcgactgtgactgcctctgccaatgagtggcgtttgctggaaggttactacacccaatctggcagcactgcattccagcatttcattatcgaagcaacggatactactgccagttattacgcggatgatttcgccatcggcggtcaagtcgtacaagttccaagcagcagctcacgcagctcaagcagtgctccggcggctagaaaattcatcggcaacatcaccacctcgggtgcagtgagatccgactttactcgttactggaaccaaattacaccagagaacgaaggtaagtggggttccgttgaaggtactcgcaaccagtacaactgggcaccgctggatcgtatttatgcttacgctcgccaaaataatattccggtaaaagctcacacgtttgtgtggggtgcgcaatcacccgcgtggctcaataacttaagcggaccggaagtcgctgttgaaattgaacaatggattcgcgattactgtactcgttaccctgacacggcgatgattgacgtagtgaacgaagcggttcctggccatcaaccggcaggttatgcacaacgagcatttggcaataactggatccaacgcgtgttccaattggctcgccaatattgccctaactcgatcctgatcctgaatgattacaacaatatccgttggcagcacaatgagtttattgcccttgcaaaagctcaaggcaattatattgatgcagtcggcctgcaggcgcatgaactgaagggtatgacagcggcgcaagtcaaaaccgcaatcgacaatatttggaaccaagtgggcaagcccatctacatttctgaatacgacattggcgataacaatgaccaggttcaattgcagaatttccaggcgcatttccctgtattctgggaccatccgcatgttaaaggcatcaccatttggggttatgtcaatggcagaacttggattgaaggctcgggcctgatttctgacaacggaacaccgcgccccgcaatgacttggttgctgaataactatatcaataagcagtaa

SEQ ID NO: 42 - protein, 630 aa, Unknown
  Obtained from an environmental sample
  SIGNAL (1)...(37)
MIHQQKPNQDIGRLFKRSCSFVGISAALAVFSHTASAACTYNIDNQWGSGFVASITVKNDTGATVNNWSVNWQYANNRITNGWSANFSGSNPYTATNMSWNGSIAAGQSVTFGFQGNTNSNTVERPVVNGSLCGTATTSSVRSSVAATSSSRSSVAPSSIPASSTPRSSTPATSSSASSFSVPANNFAQNGGVESGLTNWGTTAGTVTRSTADKHSGTASALITGRTAAWNGLTFNVGALTNGNQYQVNVWVKLAPGTPDSVLTLTGKRVDDSDTTTYNEYTRVATVTASANEWRLLEGYYTQSGSTAFQHFIIEATDTTASYYADDFAIGGQVVQVPSSSSRSSSSAPAARKFIGNITTSGAVRSDFTRYWNQITPENEGKWGSVEGTRNQYNWAPLDRIYAYARQNNIPVKAHTFVWGAQSPAWLNNLSGPEVAVEIEQWIRDYCTRYPDTAMIDVVNEAVPGHQPAGYAQRAFGNNWIQRVFQLARQYCPNSILILNDYNNIRWQHNEFIALAKAQGNYIDAVGLQAHELKGMTAAQVKTAIDNIWNQVGKPIYISEYDIGDNNDQVQLQNFQAHFPVFWDHPHVKGITIWGYVNGRTWIEGSGLISDNGTPRPAMTWLLNNYINKQ

SEQ ID NO: 43 - DNA, 1011 bp, Unknown
  Obtained from an environmental sample
atgcaaacaaatattaaaggaaataacattccatcattacacgaagtttatcaagatcactttttgataggtgcagcagttaatccaaaaacattagactcacagcaggatttattgagaaaacactttaacagtattacagctgaaaatgaaatgaaatttgaagaattgcaaccagaacctggccatttcacgtttggtgtagcagatgaaatcgtttcatttgcaaaagaaaatggaatgaaagttagaggacatacattagtttggcataatcaaacgcctgattggatgtttttgaatgaagatggatctgtcacagatcgagaaacgcttctagaaagaatgaaattacacattacaacagttatgcagcattacaaaggtcaagcttattgctgggatgttgtaaatgaggtgattgctgacgagggtacagagttattccgtaaatctaaatggactgaaattattggtgatgattttgtagaaaaggcatttgaatatgcacatgaggctgatccagaagctttactattctacaatgactataatgaatcccatcccaataagcgtgagaaaattttcacacttgtaaaaggattagttgataaggggatacctattcatggaatcggtttacaagcacattggaatttaacaggaccttcttatgaagatattagagcagcactcgagaaatatgctacattgggattggaaatacaccttaccgaattggatgtttctgtttttaattatgaagatcgaagaacagatttaacagaaccaactaaagatatgcaagcgcttcaagcggagcgttatacagaattattcaagatattgagagaatatagtcatgtaatcagttcgattactttttggggagctgcagatgattatacttggttagatgattttcctgtcaaaggaagaaaaaactggccatttgtttttgatgaaaaccaagagccaaaagagtcattttggaatattattgacttttaa

SEQ ID NO: 44 - protein, 336 aa, Unknown
  Obtained from an environmental sample
MQTNIKGNNIPSLHEVYQDHFLIGAAVNPKTLDSQQDLLRKHFNSITAENEMKFEELQPEPGHFTFGVADEIVSFAKENGMKVRGHTLVWHNQTPDWMFLNEDGSVTDRETLLERMKLHITTVMQHYKGQAYCWDVVNEVIADEGTELFRKSKWTEIIGDDFVEKAFEYAHEADPEALLFYNDYNESHPNKREKIFTLVKGLVDKGIPIHGIGLQAHWNLTGPSYEDIRAALEKYATLGLEIHLTELDVSVFNYEDRRTDLTEPTKDMQALQAERYTELFKILREYSHVISSITFWGAADDYTWLDDFPVKGRKNWPFVFDENQEPKESFWNIIDF

SEQ ID NO: 45 - DNA, 1137 bp, Unknown
  Obtained from an environmental sample
atgaagatatcacgccgacaattacttgctatgggtggtgccgctgcaaccctggcctctgccaaattattcgctgccgaaaaagctgctgccgccaccggattgaaagatgcctataaaaacgatttcctgatcggtgctgcattaaatacccaaattgttgatggcaaagaccccaaacttactgcactgatcaccaaagaatttaattcaattaccgcagagaattgccagaagtgggaaaggttgcgcaatgaaaaagatggtagctgggaatggaaagatagcgatgcctttgtgaatttcggggttgcccataacatgcatattgtcgggcatacgttgggctggcatagccaaattcccgacagcgtctttaaaaacaaagatggcagttatatttccaaagaggcactggcaaaaaaacaacaagagcacatcaccaccttagtggatcgttacaaaggcaaaattgccgcatgggatgtggttaacgaagccatgggcgatgacaacaagatgcgcgcaagccattggtacaacattatgggtgatgactttctcgtcaacgcctttaagctcgcgcatgagactgaccccaaagcacatttgatgtacaacgattacaacaacgagcgcccggaaaagcgcgcagcaacggttgatatgctcaagcgcctgttaaaactcggggcgccgatccacggtttgggaatgcaggcacatattggcctggatgcggatatgaaaaactttgaagacagtattgtcgcctattcagaattaggcttgcgtattcaccttaccgaactggatatagatgtgttgccctcggtgtggaatttgccagtcgctgaagtatctacccgttttgaatacaaaccggagcgagatccttacatcaaaggcctgccaaaagagatcgacgaaaaactcgcgaaggcttatgaatcgctatttaaaattttgcttaagcataaagacaaagtagatcgtgtgaccttctggggtgtgagtgatgatgccagctggctaaatggcttcccgatcccgggccgcaccaattatccactgttatttgaccgtaagcagcaacctaaagcagcgtacttccgcttactggatttaaagcgttaa

SEQ ID NO: 46 - protein, 378 aa, Unknown
  Obtained from an environmental sample
  SIGNAL (1)...(25)
MKISRRQLLAMGGAAATLASAKLFAAEKAAAATGLKDAYKNDFLIGAALNTQIVDGKDPKLTALITKEFNSITAENCQKWERLRNEKDGSWEWKDSDAFVNFGVAHNMHIVGHTLGWHSQIPDSVFKNKDGSYISKEALAKKQQEHITTLVDRYKGKIAAWDVVNEAMGDDNKMRASHWYNIMGDDFLVNAFKLAHETDPKAHLMYNDYNNERPEKRAATVDMLKRLLKLGAPIHGLGMQAHIGLDADMKNFEDSIVAYSELGLRIHLTELDIDVLPSVWNLPVAEVSTRFEYKPERDPYIKGLPKEIDEKLAKAYESLFKILLKHKDKVDRVTFWGVSDDASWLNGFPIPGRTNYPLLFDRKQQPKAAYFRLLDLKR

SEQ ID NO: 47 - DNA, 1137 bp, Unknown
  Obtained from an environmental sample
atgaaaagaataaagattctgaattcgattgtattagctttaatcctggcgatcatcctgccgggatgttccaatgcacagaagagcgagccggtgctgaaagatgccctttcgggaaaattttacatcggggctgctctcaataccccccaaattacgggccgggataccttgtccatgaaaatggtcaccagacattttaactccatcgtagctgagaactgcatgaaaagcggggagatccagcggaccgaaggggagtttgatttcagtcttgccgaccagtttgtcgcgttcggcgaaaaacacaacatgcacattgtggggcataccctgatatggcattcacaggcgccgcgctggtttttcaccggtgcagacggaaacgaagtcagccgggaggtactgattgagcgcatgaagaaccatatttatacggtcgtggggcgttacaaaggccgtgtccacggctgggatgtggtcaacgaagccattgaagacaacggctcatggcgcaacagcaagttttaccagatcttaggtgacgagtttgtggaactggcctttaaatttgccgcagaagccgacccggatgccgaactttactataacgactactccatggcattagaaggcaggagaaatggcgttatcagaatggtgaagaaccttcagtccaagggactcaaaattgacggtatcggcatgcaggggcatctgctcatggactcgcccacgctggaagcttatgaagaaagtatcctggcctattccggactgggcgttaaggtgatgatcacggaactcgatttgtctgcgctgccatggccagcccgtcagcagggagccgatattgccctgagggctgagtatgaggcacggatgaatccttacaccgaaggtttaaccgattcagcttccgtggcatggaatcagcggatgggcgatttcttctctcttttcctgaagcaccaggacaaaatcagcagggttaccctttggggggtcaccgataaccaatcctggaaaaataactttccgatgagaggaaggacagactacccgttgctttttgaccggaattaccaacccaaaccggtggtggaaagaatcatcaaagaagcgaaagcaaaataa

SEQ ID NO: 48 - protein, 378 aa, Unknown
  Obtained from an environmental sample
  SIGNAL (1)...(26)
MKRIKILNSIVLALILAIILPGCSNAQKSEPVLKDALSGKFYIGAALNTPQITGRDTLSMKMVTRHFNSIVAENCMKSGEIQRTEGEFDFSLADQFVAFGEKHNMHIVGHTLIWHSQAPRWFFTGADGNEVSREVLIERMKNHIYTVVGRYKGRVHGWDVVNEAIEDNGSWRNSKFYQILGDEFVELAFKFAAEADPDAELYYNDYSMALEGRRNGVIRMVKNLQSKGLKIDGIGMQGHLLMDSPTLEAYEESILAYSGLGVKVMITELDLSALPWPARQQGADIALRAEYEARMNPYTEGLTDSASVAWNQRMGDFFSLFLKHQDKISRVTLWGVTDNQSWKNNFPMRGRTDYPLLFDRNYQPKPVVERIIKEAKAK

SEQ ID NO: 49 - DNA, 996 bp, Unknown
  Obtained from an environmental sample
atgaacagctccctcccctccctccgcgatgtattcgcgaatgatttccgcatcggggcggcggtcaatcctgtgacgatcgagatgcaaaaacagttgttgatcgatcatgtcaacagtattacggcagagaaccatatgaagtttgagcatcttcagccggaagaagggaaatttacctttcaggaagcggatcggattgtggattttgcttgttcgcaccgaatggcggttcgagggcacacacttgtatggcacaaccagactccggattgggtgtttcaagatggtcaaggccatttcgtcagtcgggatgtgttgcttgagcggatgaaatgtcacatttcaactgttgtacggcgatacaagggaaaaatatattgttgggatgtcatcaacgaagcggtagccgacgaaggagacgaattgttgaggccgtcgaagtggcgacaaatcatcggggacgattttatggaacaagcatttctctacgcttatgaagctgacccagatgcactgcttttttacaatgactataatgaatgttttccggaaaagagagaaaaaatttttgcacttgtcaaatcgctgcgtgataaaggcattccgattcatggcatcggcatgcaggcgcactggagcctgacccgcccgtcgcttgatgaaattcgtgcggcgattgaacggtatgcgtcccttggtgttgttcttcatattacggaactcgatgtatccatgtttgaatttcacgatcgtcgaaccgatttggctgtcccgacgaacgaaatgatcgaacagcaagcagaacggtatgggcaaatttttgctttgtttaaggagtatcgcgatgttattcaaagtgtcacattttggggaattgctgatgaccatacatggctcgataactttccagtgcacgggagaaaaaactggccgcttttgttcgatgaacagcataaaccgaaaccagctttttggcgggcagtgagtgtctga

SEQ ID NO: 50 - protein, 331 aa, Unknown
  Obtained from an environmental sample
MNSSLPSLRDVFANDFRIGAAVNPVTIEMQKQLLIDHVNSITAENHMKFEHLQPEEGKFTFQEADRIVDFACSHRMAVRGHTLVWHNQTPDWVFQDGQGHFVSRDVLLERMKCHISTVVRRYKGKIYCWDVINEAVADEGDELLRPSKWRQIIGDDFMEQAFLYAYEADPDALLFYNDYNECFPEKREKIFALVKSLRDKGIPIHGIGMQAHWSLTRPSLDEIRAAIERYASLGVVLHITELDVSMFEFHDRRTDLAVPTNEMIEQQAERYGQIFALFKEYRDVIQSVTFWGIADDHTWLDNFPVHGRKNWPLLFDEQHKPKPAFWRAVSV

SEQ ID NO: 51 - DNA, 3162 bp, Unknown
  Obtained from an environmental sample
atgagagggaaaagcaaaaagggatttctgaacatctcagaagctgtacttgttggaattttagcaggctttcttggagttcttctcgcagctacgggggttttgagttttggtggaacagcgtcttcgtctcttgaaacggtgttcaccttgagtttcgagggaacaacgcaaggtgtcaatccctttggaaaagaagtagttctcacagcttctcaagatgtagcagccgatggcgaatattcattgaaagtagagaatagaacttccggctgggatggagttgagatcgatttaacggaaaaagtagaagcgaacaaagattatctgttgtctttctacgtctatcaaacatctgactcaccccaactttttgaagtccttgcaagaacagaagacgggaaaggtgaaaaatacgaaacccttaccgacaaggtggtagtatcgaactactggaaagaaattcttgtgcccttttccccgagtttcgagagtaccccaacaaaatgttctttgatcgttgtttcaccaaagaacccatcattcactttctatattgacaaggttcaaattctcaaaccgaagaagcaaggtccacaagtcatttacgaaacatcctttgagagtgggacgggaagctggcaagccagagggtctgatgtgaaaatcaaagtgacatcgaaagttgctcattctggaaaaaggtctctctatgtctccaacagacaaaaaggctggcatggtgtacaacttgacgtgaagagactcttgagacccgggaaaacgtatgcttttgaaggatgggtttatcaagactctggacaggatcaaacaattattctgacgatgcagagaagatattcttctgattctagcacacaatatgagtggatcaaggcggtaactgttccatcaggacaatggacgcagatctctggaacttacacaatccaaccaagagtaagcgtggaggaactcattgtttactttgaagccaaggatcccactcttgccttctatgtggacgatttcaaaataacggataccacaactactgacatcaagctcgagctgaagcctgaagaagaaattccagctcttaaagaagtgcttggagattacttcaaagtaggtgttgccttacctttcaaagtttttgccaaaccagaggatattgctctcattactaaacatttcaacagcatcactgccgaaaacgaaatgaaacctgagagtctcttggctggcgtagaaaatggaaagttgaagttcaggtttgagacagcagacaaatacgtagaatttgcacagcaaaacggtatggttgtgagaggtcacactctggtgtggcacaatcaaacaccggactggttcttcaaggacgagaacggaaatctgctctccaaagaagcaatgactgaaaggcttagggaatacatccacacagtcgtcggacacttcaaaggcaaagtttacgcgtgggacgtcgttaatgaggcagtagatccatcccaaccagatggacttagaagatctatatggtacgaaatcatgggacctgactatatagaacttgcattcaagtttgcaagagaagcggaccccaatgcaaagctcttctacaacgactacaacacctaccaggagaagaagagagacatcatttacaacctcgtcaaatccctcaaagagaagggactcattgacggtatcggtatgcagtgtcatatcggtgttgggaccagtgtcaaagagattgaagaggcaatcaaaaaattcagcaccattccaggtatcgaaattcatatcacggaactagatataagtgtgtacgaggatgcgacttccaattatccaacacctccaagggaggctctcattaaacaagcacacgtaatgagagaactctttgccatcttcaaaaagtacagcaacgtcataacaaacgttactttctggggattgaaagatgattattcctggaagaatgcccgcagaaacgactggccgctactttttgataaagactaccaagccaaacttgcctactgggccatagtcagtcctgaggctctaccggtgcttccaaagaaatggtctatcgctacaggtagtgctttggtagttggaatgatggatgactcctatttggcttcttcacctatcaaaattctcgtcgatggccaagaaaaactcacagccagagtcatctgggaagaaaacaaactcttcgtctacgcagaggtctatgacaggacaagagacaaaggaaaggacggtatcaccatctttgtggatcctaaaaacttcaaggcaccttacttgcatgaagatgctttctacgttaccataaaaaccgactggagtgttgagaagagtcgtgatgacatagaagtccagagattcgtaggtccaagtggagtaaggtacaacgttgaatgtgaaataacacttcctgaaaaactccaggaaggacagcaaatcggatttgatatcgccgtccaggatggcgataaggtctacagctggtctgatacatccaatcagcagaagctcgcaaccatgaactacggaactctcactctgcagggtgcggtaatggccacagctaagtatggcacacctgtgatcgatggtgaaatagatgacatctggtacaccactgaagaaatctcaaccgatgttgttgtcatgggttcactcaagaacgcaagggcaaaagtgagagtgctctgggatgaagagcacctctatgtgcttgccatcgtaaccgatcctgtgctcaataaggacaacaccaatccatgggaacaagactctgtagaaatcttcatagacgaaaacaacgccaaaacaccgtactatcaggacgatgatgctcaatatcgtgtcaactacctcaacgaacaatccttcggtacaggtgcaagcagcaagaacttcaagacagccgtgaaactcatcgatggtggttatcttgttgaggcagcggttaaatggaagaccatcaaaccttcaccaaacacagtgataggctttgatttccaggtgaacgatgcaaatgctcaaggtaagagagttggaatacttaagtggtgcgatccaacggacaacagctggcagaatacctccaagtttggtaatctcaggttgataaaatag

SEQ ID NO: 52 - protein, 1053 aa, Unknown
  Obtained from an environmental sample
  SIGNAL (1)...(30)
MRGKSKKGFLNISEAVLVGILAGFLGVLLAATGVLSFGGTASSSLETVFTLSFEGTTQGVNPFGKEVVLTASQDVAADGEYSLKVENRTSGWDGVEIDLTEKVEANKDYLLSFYVYQTSDSPQLFEVLARTEDGKGEKYETLTDKVVVSNYWKEILVPFSPSFESTPTKCSLIVVSPKNPSFTFYIDKVQILKPKKQGPQVIYETSFESGTGSWQARGSDVKIKVTSKVAHSGKRSLYVSNRQKGWHGVQLDVKRLLRPGKTYAFEGWVYQDSGQDQTIILTMQRRYSSDSSTQYEWIKAVTVPSGQWTQISGTYTIQPRVSVEELIVYFEAKDPTLAFYVDDFKITDTTTTDIKLELKPEEEIPALKEVLGDYFKVGVALPFKVFAKPEDIALITKHFNSITAENEMKPESLLAGVENGKLKFRFETADKYVEFAQQNGMVVRGHTLVWHNQTPDWFFKDENGNLLSKEAMTERLREYIHTVVGHFKGKVYAWDVVNEAVDPSQPDGLRRSIWYEIMGPDYIELAFKFAREADPNAKLFYNDYNTYQEKKRDIIYNLVKSLKEKGLIDGIGMQCHIGVGTSVKEIEEAIKKFSTIPGIEIHITELDISVYEDATSNYPTPPREALIKQAHVMRELFAIFKKYSNVITNVTFWGLKDDYSWKNARRNDWPLLFDKDYQAKLAYWAIVSPEALPVLPKKWSIATGSALVVGMMDDSYLASSPIKILVDGQEKLTARVIWEENKLFVYAEVYDRTRDKGKDGITIFVDPKNFKAPYLHEDAFYVTIKTDWSVEKSRDDIEVQRFVGPSGVRYNVECEITLPEKLQEGQQIGFDIAVQDGDKVYSWSDTSNQQKLATMNYGTLTLQGAVMATAKYGTPVIDGEIDDIWYTTEEISTDVVVMGSLKNARAKVRVLWDEEHLYVLAIVTDPVLNKDNTNPWEQDSVEIFIDENNAKTPYYQDDDAQYRVNYLNEQSFGTGASSKNFKTAVKLIDGGYLVEAAVKWKTIKPSPNTVIGFDFQVNDANAQGKRVGILKWCDPTDNSWQNTSKFGNLRLIK

SEQ ID NO: 53 - DNA, 2370 bp, Unknown
  misc_feature: Bacterial DNA
atgaagggcctgcaccggctccgccgccgtcgccggacctgggtggcaggactgtcggccgcggcggtggtcgccggcgccctgacgctcctccccggctccgccggcgccgcgggcctgggtacgcacgcggccccctcgggccggtacttcggcacggccgtggccgcgggccgcctcggcgactcggcgtacaccgcgatcgccgaccgggagttcaacatgatcaccccggagaacgagatgaagtgggacgccgtcgagccgtcccgcggccgtttcgacttcggtcccgcggaccggatcgtcgagcgtgccctggcacgcggccagcgcgtccgcggccacaccacggtctggcactcgcagctcccctcctgggtgggctccatccgcgacacgaagacgctgcgcggcgtgatgaaccaccacatcaccacccagatgacccactacaagggcaagatctacgcctgggacgtggtcaacgaggccttcgccgatggcggcagcggccggctccgcgactcggtcttccagaaggtgctgggcgacggcttcatcgaggaggcgttccgcaccgcccgcgcggccgacccctcggccaagctctgctacaacgactacaacatcgagaactggtcggacgccaagacccagggcgtctaccgcctggtgaaggacttcacgtcccgaggcgttcccatcgactgcgtcggcttccagagccacttcggcgcgggcggcccgccggcgagcttcaagacgaccctggccaacttcgccgccctgggcgtcgacgtccagatcaccgagctggacatcgcccaggcatcacctgcccactacgcgagtgcggtcagcacctgtctgtccgtggcccggtgcaccggcatcacggtgtggggcgtccgtgacagcgactcctggcggagcgccgaaagcccgctgctgttcgaccggaacggcaagcccaagcccgcgtacgccgccgtcatgaacgccctcggctccggctcgggtcccaccccgagcaagccggccgacggtacggggagcggtacgggggagatcaagggcgtggcctccggccgctgtctggacgtccccgcctccaccaccgccaacggcacccgggcgcagctgtgggactgtagcggccaggccaaccagcgctggacccacaccgccggcaagcagctgaagatccacggcgacaagtgcctggacgccaagggcaagggcaccgccaacggcaccgcggtggtcgtctgggactgcaacggcggcaccaaccagcagtggaacgtccacaccgacggcacgatcaccggcgtccagtccggtctgtgcctcgatgccgtcggcgcggccaccgccaacggcaccccgatccagctgcacgcctgtgggggtgtcggcaaccagaagtggtccgccccgtccggatcgggcggcggcacgtgcgtgcttccgtcgacgtacaagtggagctcgacgggtgccctggcgcagcccaaggccgggtgggcctcgctgaaggacttcacccatgtggtgctgggcggcaagcacctggtctacgggtcgaacttcaacggatcgacgtacggctcgatgacgttcagccccttcaccacctggtcggacatggcgtccgcaggacagaaggcgatgaagcagcccgcggtcgcacccaccctgttctacttcgcacccaagaagatctgggtgctggcgtaccagtggggcaggaccgcgttctcctaccggacgtcgaccgaccccaccaacccgaacggctggtcggcggagcaggagctcttctccggaagcatcaccggctcgggcacgggccccatcgaccagacgctcatcggcgacgggacgaacatgtacctgttcttcgccggtgacaacggcaagatctaccgggccagcatgccgatcgggaacttcccgggcagcttcggctcctcgtacacgacggtcatgagcgacaccgcgaagaacctgttcgaggcgccgcaggtgtacaaggtcaaggaccagaaccagtacctcatgatcgtcgaggcccggggcgcgggcgagcgccgctacttccgctcgttcacggcctccagcctgagcggtgcgtggaccccgcaggccgcgaccgagagcaaccccttcgcgggcaaggccaacagcggcgccacctggaccgacgacatcagccacggtgatctgatccgcaccaaccccgatcagaccatgaccatcgacccctgcaaccttcagctgctctaccagggcaagtccccgcaggcgggcggaccctacgaccagctgccgtaccggccgggcgtcctcaccctgcagcgctga

SEQ ID NO: 54 - protein, 787 aa, Unknown
  DOMAIN (1)...(787): Bacterial protein
  SIGNAL (1)...(37)
MKGLHRLRRRRRTWVAGLSAAAVVAGALTLLPGSAGAAGLGTHAAPSGRYFGTAVAAGRLGDSAYTAIADREFNMITPENEMKWDAVEPSRGRFDFGPADRIVERALARGQRVRGHTTVWHSQLPSWVGSIRDTKTLRGVMNHHITTQMTHYKGKIYAWDVVNEAFADGGSGRLRDSVFQKVLGDGFIEEAFRTARAADPSAKLCYNDYNIENWSDAKTQGVYRLVKDFTSRGVPIDCVGFQSHFGAGGPPASFKTTLANFAALGVDVQITELDIAQASPAHYASAVSTCLSVARCTGITVWGVRDSDSWRSAESPLLFDRNGKPKPAYAAVMNALGSGSGPTPSKPADGTGSGTGEIKGVASGRCLDVPASTTANGTRAQLWDCSGQANQRWTHTAGKQLKIHGDKCLDAKGKGTANGTAVVVWDCNGGTNQQWNVHTDGTITGVQSGLCLDAVGAATANGTPIQLHACGGVGNQKWSAPSGSGGGTCVLPSTYKWSSTGALAQPKAGWASLKDFTHVVLGGKHLVYGSNFNGSTYGSMTFSPFTTWSDMASAGQKAMKQPAVAPTLFYFAPKKIWVLAYQWGRTAFSYRTSTDPTNPNGWSAEQELFSGSITGSGTGPIDQTLIGDGTNMYLFFAGDNGKIYRASMPIGNFPGSFGSSYTTVMSDTAKNLFEAPQVYKVKDQNQYLMIVEARGAGERRYFRSFTASSLSGAWTPQAATESNPFAGKANSGATWTDDISHGDLIRTNPDQTMTIDPCNLQLLYQGKSPQAGGPYDQLPYRPGVLTL

SEQ ID NO: 55 - DNA, 1143 bp, Unknown
  Obtained from an environmental sample
atgaaaaaaacgattgcacatttcaccttatggatagcgttttttctcttcacttcctgtgctgttacggcgcagaagaatactaagaatgcaagagtaaagcccactactctaaaagaggcttaccaaggtaaattctatatcggtacagcgatgaatctgagacagattcacggagatgatccccagtctgaaaatattatcaaaaaacagttcaattccattgttgctgaaaactgcatgaagagtatgtatcttcagccggaggaaggaaaatttttcttcgatgatgcggataagtttgtggattttggtcttcagaacaatatgtttattatcgggcattgtctgatttggcattcgcaggcgccaaaatggtttttcaccgacgagaatgggaaaacggtctccccagaagttcttaaacaaaggatgaaagctcatatcaccgccgtcgtttctcgctacaaagggaaaatcaaaggatgggatgtggtgaacgaagccattatggaagatggttcttaccgcaaaagcaaattttacgagattttgggagaagaatttattccgttggcatttcagtatgcgcatgaagcagatcctgatgcagaactctattacaacgattataacgaatggtatcccggaaaaagagctacggtgaccaaaataatccgagatttcaaatctagaggaatccgcattgatgccattggaatgcaggctcatttcgggatggattcacccactatagaagagtatgaacaaactattcagggctatataaaagaaggcgtgaaagtcaatattacggaactcgatttgagtccacttccttccccttggggaacttccgccaacgttgccgatacgcagcagtatcaggaaaaaatgaatccttacaccaaaggacttcccacagaggtggaaaaagcttgggaaaaccgttatctcgattttttcaaactattcctaaaatatcatcagcatatcgagcgtgttacgttttggggcgttagcgatatcgattcctggaagaacgattttccagtgagaggacgtaccgattatccgttaccctttgaccgacagtatcaggcaaaacctttggttcagaaattaatagacttaacgaaatag

SEQ ID NO: 56 - protein, 380 aa, Unknown
  Obtained from an environmental sample
  SIGNAL (1)...(24)
MKKTIAHFTLWIAFFLFTSCAVTAQKNTKNARVKPTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGKTVSPEVLKQRMKAHITAVVSRYKGKIKGWDVVNEAIMEDGSYRKSKFYEILGEEFIPLAFQYAHEADPDAELYYNDYNEWYPGKRATVTKIIRDFKSRGIRIDAIGMQAHFGMDSPTIEEYEQTIQGYIKEGVKVNITELDLSPLPSPWGTSANVADTQQYQEKMNPYTKGLPTEVEKAWENRYLDFFKLFLKYHQHIERVTFWGVSDIDSWKNDFPVRGRTDYPLPFDRQYQAKPLVQKLIDLTK

SEQ ID NO: 57 - DNA, 1578 bp, Unknown
  Obtained from an environmental sample
atgaaaagaatgatcggtttgctgctggccatttgcctggtgatgacgctggctggggcctgggctgcctcggatacgctggtctatgcatccagtttcgcagcgggcgatgacgactggtttgcaaggggcgcttcccgggtttaccataccacggaggcgacgctgcggacggaaggccggagcgacaactggaattctccgggacgctattttgaactggtgccggataatgaatatacgctgagcgtggaggtctaccaggacggagcggacagcgcgaacttcatgatttccctggaaaaggttgcggatgggatcaccggatgggaaaacctggtgcggggaaccgtgaaaaagggtgaatggacgacgctgtccggaacctatacttttgcagactatgaaagctatgtgctgtatgtggagacctccgacgcgccgacgctggactttgagatccggaatttccgggtggaaagccccaatgggatcccggagccgaaggctaccgaggcgccggcagtggtttcggaagccacggatattccgagcctgaaggacgcttacgcggattacttcgactttggcgcggccgtgccgcagtctgctttcaccagcagagataatattcagctgatggagctgatgaaaaaccagttcagcatcctgacgcctgaaaatgagctgaagccggacagtgtattggatgtaagcgccagcaagcagctggccaaagaggatgaaaccgcggtagtggtgcggtttaacggggcaaagtcattgctgcggtttgcccagcaaaacggcatcaaggtgcacgggcatgtgctggtctggcacagccagacgccggaagcctttttccatgaaggatatgatcccaagaacccgctggtgagccgggaagtgatgctgggacggctggaaaactatatccgggaagtgctgacccagacggaagaactgtatccgggcgtgatcgtcagctgggacgtggtgaacgaagcgattgacgacggaaccaactggatccggaagggatcgggctggtaccggaccatcggggaagactatgtggagaaggcttttgagtttgcccggaagtatgccccggaaggcgtgctgctgtactacaacgattacaacacggcatacgccggaaaactgaatgggattatcaaactgatcaaacccatgatcgagcagggaacgatcgacggatacggcttccagatgcaccatacgaccgggcagcccagcaaccagatgatcaccacggcggtggagaagatcgcggccctgggaatcaagctgcgggtcagcgagatggacatcgggattacaaagtatacagagacgagcctgcaggcacaaaaggacaagtacaaggcgatgatggaactgatgctgcggttcgcggaccagacggaagcagtgcaggtctgggggattacggatacgatgagctggcggagctccagctatccgctgctgtttgaccggagcaggaatccgaagccggcgttctatggcgtgattgaagcggttgaagactggacagggaaaagtgaatag

SEQ ID NO: 58 - protein, 525 aa, Unknown
  Obtained from an environmental sample
  SIGNAL (1)...(22)
MKRMIGLLLAICLVMTLAGAWAASDTLVYASSFAAGDDDWFARGASRVYHTTEATLRTEGRSDNWNSPGRYFELVPDNEYTLSVEVYQDGADSANFMISLEKVADGITGWENLVRGTVKKGEWTTLSGTYTFADYESYVLYVETSDAPTLDFEIRNFRVESPNGIPEPKATEAPAVVSEATDIPSLKDAYADYFDFGAAVPQSAFTSRDNIQLMELMKNQFSILTPENELKPDSVLDVSASKQLAKEDETAVVVRFNGAKSLLRFAQQNGIKVHGHVLVWHSQTPEAFFHEGYDPKNPLVSREVMLGRLENYIREVLTQTEELYPGVIVSWDVVNEAIDDGTNWIRKGSGWYRTIGEDYVEKAFEFARKYAPEGVLLYYNDYNTAYAGKLNGIIKLIKPMIEQGTIDGYGFQMHHTTGQPSNQMITTAVEKIAALGIKLRVSEMDIGITKYTETSLQAQKDKYKAMMELMLRFADQTEAVQVWGITDTMSWRSSSYPLLFDRSRNPKPAFYGVIEAVEDWTGKSE

SEQ ID NO: 59 - DNA, 1104 bp, Unknown
  Obtained from an environmental sample
atgcttgccagtagtgccggtttggtagcatcccaactcaagctgtccgcgttagctgcagctaaaaatgctggattaaaagatgtatataaggatcgctttctgattggtgcagcaattaatacctcgattgcgagcggccagcaacctgatattacagaaattatcaagcgtgatttttcgtcgttaacacctgaaaatgcaatgaagtgggaatctgtcaggactgctgatggcggatggaaatgggcagatgccgatcaattcgttacgtttgcaacagaacacaaaatacacgctgttggccacacccttgcctggcatagccagattcccgattccgtattcaaaaatgaaaaaggcgaatacataaaatccaccgagctatcaaaaaaaatggaagaacatatcactacgattgtaggtagatataaaggcaaactcgatgcctgggatgtagttaatgaggctgttggtgatgataatcaaatgcgcaaaagccattattacaatattctcggcgaagattttattgataaggcatttcaccttgcgcatgaggtcgatcccaaagcgcatttaatgtataacgactacaacattgaaaaagatggcaagcgtgaagctacccttgaaatgttaaagcgtttacaaaaacgcggtgtaccgattcatgggctcggcatccagggacatattgccgttgatggccccagcattgcggatattgaaaaaagtattttggcttatgcggatttgggtttgcgtgtacatttcaccgagttggatattgatgtattgccgcaaatctggaacttaccggttgcagaaatttctacacgcttcgaatacaaacctgagcgagatcctttcaaaaatggtttatcaaaagaaatgaacgataaactcagtgcacgctatgaagaattattcacattatttattaaacacaaagataaaattgatcgtattactttgtggggtgtcagcgatgatgcaacctggctaaatgatttccccatcaaaggcagaaccagttatccattattgtttgatcgcaagcatcaaccaaaagatgcttattataacattctggcgttgtga

SEQ ID NO: 60 - protein, 367 aa, Unknown
  Obtained from an environmental sample
  SIGNAL (1)...(21)
MLASSAGLVASQLKLSALAAAKNAGLKDVYKDRFLIGAAINTSIASGQQPDITEIIKRDFSSLTPENAMKWESVRTADGGWKWADADQFVTFATEHKIHAVGHTLAWHSQIPDSVFKNEKGEYIKSTELSKKMEEHITTIVGRYKGKLDAWDVVNEAVGDDNQMRKSHYYNILGEDFIDKAFHLAHEVDPKAHLMYNDYNIEKDGKREATLEMLKRLQKRGVPIHGLGIQGHIAVDGPSIADIEKSILAYADLGLRVHFTELDIDVLPQIWNLPVAEISTRFEYKPERDPFKNGLSKEMNDKLSARYEELFTLFIKHKDKIDRITLWGVSDDATWLNDFPIKGRTSYPLLFDRKHQPKDAYYNILAL

SEQ ID NO: 61 - DNA, 1041 bp, Unknown
  Obtained from an environmental sample
atgagaagaagcatggaaaggctgcccaagctccatgaagcttacggcaatagtttcaagatcggcgctgccgtgaatccaattacgatggtgacccaaaaggaattgttgtcacaccacttcaacagcgttacggcagaaaatgaaatgaaattcgagcgattgcacccatcggaagaggtgtatacattcgagcaagccgaccagatcgtatcgtttgccaaatcgaacggaatgtcggtgagaggacataccctcgtatggcataatcagacgccggaatgggtgtttcaagacagttccggtgggacagccggccgcgagctgctgctcgctcggatgaaatcgcacatcgatgaggtcgttggccgttatcgcggagatatctatgcttgggatgtcgtaaacgaagccattgccgacagtggaagcgatctgcttcgttcctccccgtggcttgcgtcgatcggggaggattttatcgccaaggctttcgaatatgcgcacgaagcagacccgcaagcgctgctgttttataacgattacaacgaatccgtgcccgagaagcgggagaagatttacacgctccttaaatcgttaaaggagcaggatgtgccgattcacggcgtcgggcttcaggcccattggaatttggagtttccatcgcttgacgatatccgcagggcaatcgaaaggtatgcaagccttggcatgatcttgcatatcacggagcttgacgtatccgtattcgcgcatgaggataagcggaccgatctggcggcgccgaccgaagaaatgcttgagcgccaggcggagcgttacggtcaattgttccgtctgcttaaagagtacagcggcagcgtcacttccgtgaccttctggggagcggcggacgattatacctggctggatcattttccggtaaggggccgcaaaaattggccgttcgtcttcgacgagaaccatcttccgaaggaatcctattggaacctgttgaaggaagccaatcccgaaagaacattccaagagatacgttcgtaa

SEQ ID NO: 62 - protein, 346 aa, Unknown
  Obtained from an environmental sample
MRRSMERLPKLHEAYGNSFKIGAAVNPITMVTQKELLSHHFNSVTAENEMKFERLHPSEEVYTFEQADQIVSFAKSNGMSVRGHTLVWHNQTPEWVFQDSSGGTAGRELLLARMKSHIDEVVGRYRGDIYAWDVVNEAIADSGSDLLRSSPWLASIGEDFIAKAFEYAHEADPQALLFYNDYNESVPEKREKIYTLLKSLKEQDVPIHGVGLQAHWNLEFPSLDDIRRAIERYASLGMILHITELDVSVFAHEDKRTDLAAPTEEMLERQAERYGQLFRLLKEYSGSVTSVTFWGAADDYTWLDHFPVRGRKNWPFVFDENHLPKESYWNLLKEANPERTFQEIRS

SEQ ID NO: 63 - DNA, 1110 bp, Unknown
  Obtained from an environmental sample
atgaaacgaattttaattggtttggcggctcttaccgcttccgggctgtcggcgcagaaatccgacggtactttaaaaaaagcatttcaggataaattctatatcgggactgcgatgagtcttcctcagattgatgggacagataaaagagcggtagccattatcagaaatcagttcagttctattgttgctgaaaactgtatgaaatcgatgtttctgcaacctcaggaaggaaagttcttctttgatgacgctgataaatttgttgatttcgggatgaaaaacaatatgttcgtcatcggacatacgctaatctggcattcccagcttccaaaatggttttttacagataaaaatggaaaagatgtttctccggaagtattgaaacagcgcatgaaaaaccacattacaaccgtagtttcccgttacaaaggaaaagtaaaaggatgggatgtggtgaatgaagccattcttgaagacggaacctatagaaaaagtaaattttacgaaattctgggtgaagattttattcctttggcgtttcagtatgcacaggaagccgatcccaatgcagaattatattacaacgattataatgaatggtatccggaaaaggtaaaagcagtcattacaatggttgaaaagcttaaatcaagaggaatccgtattgatggagtaggaatgcaggcccatgtcggaatggatatcccttccatcaatgaatatgaaaaagcaattctggcgtattccaatgccggagttaaagttaatattacggagctggaaattagtgcgctgccttctccgtggggaagctctgccaatgtttcagataccgttgcctatcagaaagaaatgaatccttacaccaaagggcttcccaatgaagtagaagcgaaatgggaaaaacgttaccttgatttctttagcttgtttttaaaacataaagataaaataagaagggtgaccttatggggagttactgataagcagtcctggaaaaacgattttccggtaaaaggaagaacagattacccgttgctgtttgacaggaaagatcaggagaaacctgtagtacaaaaaataataaaattggcagagaaaaattaa

SEQ ID NO: 64 - protein, 369 aa, Unknown
  Obtained from an environmental sample
  SIGNAL (1)...(20)
MKRILIGLAALTASGLSAQKSDGTLKKAFQDKFYIGTAMSLPQIDGTDKRAVAIIRNQFSSIVAENCMKSMFLQPQEGKFFFDDADKFVDFGMKNNMFVIGHTLIWHSQLPKWFFTDKNGKDVSPEVLKQRMKNHITTVVSRYKGKVKGWDVVNEAILEDGTYRKSKFYEILGEDFIPLAFQYAQEADPNAELYYNDYNEWYPEKVKAVITMVEKLKSRGIRIDGVGMQAHVGMDIPSINEYEKAILAYSNAGVKVNITELEISALPSPWGSSANVSDTVAYQKEMNPYTKGLPNEVEAKWEKRYLDFFSLFLKHKDKIRRVTLWGVTDKQSWKNDFPVKGRTDYPLLFDRKDQEKPVVQKIIKLAEKN

SEQ ID NO: 65 - DNA, 1557 bp, Unknown
  Obtained from an environmental sample
atgaaaagaatcggactgttgctgctggctgtgatcatgcttgtgggctgtgtatattccgcggcggcggaggatacgctggtttatgcttccacttttgtggccggaacggacggatggtacgcccgcggagcgcagaaagtataccgcacaaccgaggagacactgcggacggaaggccggaccagcgactggcattccccgggccgtgattttgacctggtggaaggcggcgtctatgtcctgagcgtggaagtgttccaggacgaagcggacaacgccagcttcatgatttccatcgcccacagcaaggacggtacggaaacctatgaaaacctggctcgcggaaccgccaaacgcggcgagtgggtcaccctgaccggaacatataccgccggcaattttgaccggaacgtcctgtatgtggaaacgaccggatcgccggaactgagctatgaaatccggaatttccgggttgaagcgccgaacggagttccggagccgaaggctacggagcccccgatggtgattgaggcggtggagaacctcccgggcctgaagaacgcgtatgcgggaaaatttgatttcggcgcggcggttccgggatacgctttcggcgatccgggcctgaaacagctgatgactgagcagttcagcatcctgacgcccgaaaacgaactgaaaccggacgctgtgctggacgtggcggcgagcaagcggctggcccaggaggatgaaacggcggtggcggttcattttgacggcgccattccgctgctgaactttgcccgggacaacggcatcagggtgcacggacatgtgctgatctggcacagccagacgccggaagcgttcttccatgagggctatgacacctccaagcccctggtcagccgggaagtgatgctgggccggatggaaaactatatccgcgaggtgctgacctggacgaacgagaattatccgggcgtgatcgtatcctgggacgtggtgaacgaagccattgatgacggaacgaactggctgcggaattccaactggtacaagacggtgggcggcgactttgtgaaccgggcttttgaatttgcccgcatgtacgcggcggacggcgtcctcctgtattacaatgattacaataccgcctatccggccaaacggaagggaatcatcaagctgctgggccagctgattgaggaaggcaatattgacggatacggcttccagatgcatcacagcaccggcgagccttccatggagatgatcaccgcttcggtggaggaaatcgccgcgctgggaataaaactgcgggtcagcgagctggatgtgggcatgggcagcagcatgacggaagaagccctgatgaaacagaaggacaaatacaaggcggtcatggaactgatgctgcggtttgccgaccagacggaagcggtgcaggtatggggactgacggacaatatgagctggcggaccggccagaatccgctgctgtttgaccggaaccggaacccgaagccggccttcttcggcgtcctggaagcggcggaagaaagcaaataa

SEQ ID NO: 66 - protein, 518 aa, Unknown
  Obtained from an environmental sample
  SIGNAL (1)...(22)
MKRIGLLLLAVIMLVGCVYSAAAEDTLVYASTFVAGTDGWYARGAQKVYRTTEETLRTEGRTSDWHSPGRDFDLVEGGVYVLSVEVFQDEADNASFMISIAHSKDGTETYENLARGTAKRGEWVTLTGTYTAGNFDRNVLYVETTGSPELSYEIRNFRVEAPNGVPEPKATEPPMVIEAVENLPGLKNAYAGKFDFGAAVPGYAFGDPGLKQLMTEQFSILTPENELKPDAVLDVAASKRLAQEDETAVAVHFDGAIPLLNFARDNGIRVHGHVLIWHSQTPEAFFHEGYDTSKPLVSREVMLGRMENYIREVLTWTNENYPGVIVSWDVVNEAIDDGTNWLRNSNWYKTVGGDFVNRAFEFARMYAADGVLLYYNDYNTAYPAKRKGIIKLLGQLIEEGNIDGYGFQMHHSTGEPSMEMITASVEEIAALGIKLRVSELDVGMGSSMTEEALMKQKDKYKAVMELMLRFADQTEAVQVWGLTDNMSWRTGQNPLLFDRNRNPKPAFFGVLEAAEESK

SEQ ID NO: 67 - DNA, 1224 bp, Unknown
  Obtained from an environmental sample
atgcggaacgtcgtgcgtaaaccattgacaatcggactcgctttaacactattattgcccatgggaatgacggcaacatcagcgaagaatgcagattcctatgcgaaaaaacctcacatcagcgcattgaatgccccacaattggatcaacgctacaaaaacgagttcacgattggtgcggcagtagaaccttatcaactacaaaatgaaaaagacgtacaaatgctaaagcgccacttcaacagcattgttgccgagaacgtaatgaaaccgatcagcattcaacctgaggaaggaaaattcaattttgaacaagcggatcgaattgtgaagttcgctaaggcaaatggcatggatattcgcttccatacactcgtttggcacagccaagtacctcaatggttctttcttgacaaggaaggcaagccaatggttaatgaaacagatccagtgaaacgtgaacaaaataaacaactgctgttaaaacgacttgaaactcatattaaaacgatcgtcgagcggtacaaagatgacattaagtactgggacgttgtaaatgaggttgtgggggacgacggaaaactgcgcaactctccatggtatcaaatcgccggcatcgattatattaaagtggcattccaaacagcgagaaaatatggcggcaacaagattaaactttatatcaatgattacaataccgaagtggaaccaaagcgaagcgctctttataacttggtgaagcaattaaaagaagagggcgttcctattgacggcatcggccatcaatcccacattcaaatcggctggccttctgaagcagaaatcgagaaaacgattaacatgttcgccgctctcggcttagacaaccaaatcactgagcttgatgtgagcatgtacggttggccgccgcgcgcttacccgacgtatgacgccattccaaaacaaaagtttttggatcaggcagcgcgctatgatcgtttgttcaaactgtatgaaaagttgagcgataaaattagcaacgtcaccttctggggcatcgccgacaatcatacgtggctcgacagccgtgcggatgtgtactatgacgccaacgggaatgttgtggttgacccgaacgctccgtacgcaaaagtggaaaaagggaaaggaaaagatgcgccgttcgtttttggaccggattacaaagtcaaacccgcatattgggctattatcgaccacaaatag

SEQ ID NO: 68 - protein, 407 aa, Unknown
  Obtained from an environmental sample
  SIGNAL (1)...(28)
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQTARKYGGNKIKLYINDYNTEVEPKRSALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 69 - DNA, 1596 bp, Unknown
  Obtained from an environmental sample
atggcgatgcatagatttaagcaattaggggccatcctacttgtcctatggttttgtgcattgccagtgcaggcgcaggcttggcgtgcggccgcagagcagcgtattgaacagtaccgtaaggggccactgcgggttcaggtgaaggatcctgaaggacggcccgtaccgaatgcccaagtgcacgttcgcatgacgcgtcacgcttttggatttggtacggctgtcagctttggcctggtcgtggggtcgggatacaaccccacctatcgggccaagctagaagacctgacgggcgacggccgcacattcaacatggctacgccagagaatgaattgaagtggcctgcgtgggagtcggaatggcccatttcgaatcgtcgaaagatcgacgtcatcaactggctgcgcgcaaaaggctacagcattcgaggacacaacctgctatggcctgactggcaatggatgccccgtgatattgagcaaaaccgcaacaatccacagtacatctacgatcgcgttcgcaatcacattgcggcgttggctgggcatcgggacattcggggcaaactgcgggactgggatgttcttaacgaaccagcccacctgaccgcattgcgcgatgtgtttaacggttggggctcatatgagcgtggggaagacttctatgtggatgtctttaggtgggccaaggcagcagactcgaccgcccgtctatacatcaacgagtacaacattatcaacaactacgccaacgagcagcctacgcgcaactattacaagtggatcattgcacgcctaatctcaaaaggagcgcctatcgaagggatcggcattcaggggcatatttcggcaccactgccaagcatgagtgaggtcaaggcagccctagacgaaatggcagtttttggattgcctttggccatcacagaatacgacgttaccggcgtttcggaagaagtcgaagccaactttatgcgggactttttgaccatggtctttagtcatcccgctgtggagagcttcgtcatgtggggtttctggagcggagcacactggcgtgacaatgcgccgctgtttcgggccgactggagtctcaagccttcgggacaggtgttccttgatctggtctttcggcgctggtggaccgatactacgggggtaaccggtccagatggcagctggtctgtacgcggatttttaggggattacgttgtggaagtgcaggtgggggaggtttcagtgaccaagtccctgcgcctcgaaagcccgcaggatacaaccacgctagaggtggtggtcagtagcgttaaggtgggtgaaaagcctacagaagacgtgttgcgcgtgcaagggtttggaccagacccctttgtcgaaggaacggcgctgcgctactggttagggcggccggccgatgttgaactggcagtgtatgatgtgctgggccgacaggtctacgccgtgcaaaagcatcgcgtagctggttggcatactgaatgggtcgaggcttcccactggcctgcaggactttatctgtaccgactccaagcaggtgatctgttgcacacgggtagaatggtcaagatccaataa

SEQ ID NO: 70 - protein, 531 aa, Unknown
  Obtained from an environmental sample
  SIGNAL (1)...(25)
MAMHRFKQLGAILLVLWFCALPVQAQAWRAAAEQRIEQYRKGPLRVQVKDPEGRPVPNAQVHVRMTRHAFGFGTAVSFGLVVGSGYNPTYRAKLEDLTGDGRTFNMATPENELKWPAWESEWPISNRRKIDVINWLRAKGYSIRGHNLLWPDWQWMPRDIEQNRNNPQYIYDRVRNHIAALAGHRDIRGKLRDWDVLNEPAHLTALRDVFNGWGSYERGEDFYVDVFRWAKAADSTARLYINEYNIINNYANEQPTRNYYKWIIARLISKGAPIEGIGIQGHISAPLPSMSEVKAALDEMAVFGLPLAITEYDVTGVSEEVEANFMRDFLTMVFSHPAVESFVMWGFWSGAHWRDNAPLFRADWSLKPSGQVFLDLVFRRWWTDTTGVTGPDGSWSVRGFLGDYVVEVQVGEVSVTKSLRLESPQDTTTLEVVVSSVKVGEKPTEDVLRVQGFGPDPFVEGTALRYWLGRPADVELAVYDVLGRQVYAVQKHRVAGWHTEWVEASHWPAGLYLYRLQAGDLLHTGRMVKIQ

SEQ ID NO: 71 - DNA, 1269 bp, Unknown
  Obtained from an environmental sample
atgatttccatcgcccattcagtgaacggggcggagacctatgagaacctggcgcacggaactgccaaaaaaggcgaatggactacgctgaaggggacatacaccgccggcgcctatcagcgcaacgtgctctatgtggaaacggtttctgaaggcacccttgactttgagatccgtaattttgtcctgacggctccgaacggactaccggagcccaagccgaccgagcctccgatggtcatcgaggaagccgagaacgtgcccagtctcaaagagatttatgcagacaaattcgatttcggctccgccgcgccccagatggtattccgtgaccccaaatggctcaacctgatgaaggaacagttcagcattctgacgccggaaaacgaaatgaaaccggattccgttctggatgtgggcgcgagcaaagcgctggtgaaggaaaccggtgatgagaccgccgtcgccgttcatttcgacgctgccaaagcgctgctgaattttgccaagagcaacgggatcaaggttcacggccatgtgctgatctggcacagccagacgccggaagctttcttccatcagggatatgattccaagaagcctttcgttacacgggaagtgatgctgggccgaatggaaaattacattaagggtgtttttgaatacctggatgaaaattatcccggcgtcgttgtctcctgggacgtgctgaatgaggcgattgacgacggaagcaactggctgcggaacagcaactggagaaagattgtcggcgaagactatccgaaccgggcatatgaatatgcgcgcaaatatgcgccggaaggtacgctgctgtattacaacgattacaatacgtcgattcccgggaaactgaacggcattgtgaaactgctgaacagtctgattccggaaggaaatatcgacggttacggcttccagatgcaccatggcgtcggcttcccgtccattgatatgatccagactgcagtggaacggattgccgcgctgaatatccgccttcgcgtcagcgaactggatgtcacggtggacaacaacacggaagcgtccttcaacaaacaggcaaagtattatgccgaagtcatgaagattctgattgctcacagcgaccagtttgaggctgtgcaggtctgggggctgacagacctgatgagctggcgcggcagtcagttcccgctgctgtttgacggggcaggcaatccgaaaccggcgttctgggccgtcgcggatccggattccgtgaaataa

SEQ ID NO: 72 - protein, 422 aa, Unknown
  Obtained from an environmental sample
MISIAHSVNGAETYENLAHGTAKKGEWTTLKGTYTAGAYQRNVLYVETVSEGTLDFEIRNFVLTAPNGLPEPKPTEPPMVIEEAENVPSLKEIYADKFDFGSAAPQMVFRDPKWLNLMKEQFSILTPENEMKPDSVLDVGASKALVKETGDETAVAVHFDAAKALLNFAKSNGIKVHGHVLIWHSQTPEAFFHQGYDSKKPFVTREVMLGRMENYIKGVFEYLDENYPGVVVSWDVLNEAIDDGSNWLRNSNWRKIVGEDYPNRAYEYARKYAPEGTLLYYNDYNTSIPGKLNGIVKLLNSLIPEGNIDGYGFQMHHGVGFPSIDMIQTAVERIAALNIRLRVSELDVTVDNNTEASFNKQAKYYAEVMKILIAHSDQFEAVQVWGLTDLMSWRGSQFPLLFDGAGNPKPAFWAVADPDSVK

SEQ ID NO: 73 - DNA, 4455 bp, Unknown
  Obtained from an environmental sample
atgcagaaaatgagaagaaaattgaaaagaattatgttattacttctggcagctatgttgataatcccgtcaggctggattacacaggcttcagcagcggaaacaaacaaagatatacctgttctactgtaccatcgaattgttgataatcctactaatcaatggacggataccagcgttgaaacgtttaaacagactatgcaatatctaaatgatagcggttacaacaccttgtcagccgaacaatatgtaaagatcatggatggaacggcaacggcgcctgaaaaaccgattctattaacgtttgacgatggtactccagaatttatcaccaatgctcttccagtattaaagcaatataacatgaaagctgttctgtttattgtcagtgactggataggcggcggcttcagcatgtcaaaagaacagctgcaaagtttggctaatgaaccatctttaagcctcgaaaatcatacgaaaacccatgacggtactatttggggaacaaatggcggtgtacgtagtacgataacgaaagaacaagctgaggaccaaattatatcagcgaatacttatcttaaaagtattacaggtaaagacccagtcctaatggcatacccttatggcagctataatgatattgcaaaactagtaaaccaagaaaatggtattaagtacgcatttaaagtgggataccctaatgaagataattatgctatgggccgtcactatgtaacaaatcaaagtgtggctcaaattgcccaaatgattggcggccctgtgccagaaccaactccagaaccaggaaaccagacagaaaccgtctatcaagaaacctttgccagtgatattggtgtagcagttcaagcgggtaacccacaagtaacccacgtttctggtatggtttttgcaggcaatgacgatggaaaagccatctctgttagcggcaggacgaacaactgggacggcgtcgatatcccattcaacaatgtcggtatggaaaacggcaaaacttatacgattacagttactggttatgttgacgaaaatgcaactgttccttctggcgcacaagctttactgcagaatgtagacagctataacggtttgtatgttgccgcagattatgcagcgggacaggcttttactttaacgggtcagtataccgtggatactagtaaagatagagccctacgtatccaatcaaatgatgctgggaaaactgttccgttttacattggaaacatcttgattacaacgaaaaaaacgactgcgcctgaaacagatagagtggtatttcacgaaacatttggaaatggtgttggtgttgctacacaagcgggaagtgcgaaattgactcctgtttctgagcttgtttttgaaggcaatagcgatggaaaagcaatttctgttaatggcagatccaataactgggacggagttgatataccgttcagcagtgtcagcatgcagaacggcaaagcctataccattacagtcactggttttgtttatagcagtgtgagtgttcctgaaggtgcacaagctttgcttcagaatgtagacagctataatggcttgtatgcagcagcagatgttaaggcaggtcaaacatttactctaacgggtcaatataccgttgatacgagcaaagatagagcactacgaattcaatcaaatgatgcagggaaaaccgttcccttctatatcggagatattctcattaccgagaaggcagcctctggtggtggcggggacgatggaagactacctgccgaaccatttacagcaattaattttgaagaccaaaatatgggtggtttcgagggaagagctggtaccgaaacactaacagtaaccaatgaagccaatcatactgatggcggttcctatgctttgaaggttgaaggcagatcacaagcttggcatggaccagcattacacgtagagaaatatgttgacaaggattcggaatataaaatttctgcctgggtgaagctgatttcaccagcaacttcacagcttcagctttctacacaggtcggcaatggcggaactgctagttacaataatcttcaaggaaaaactatcagcactgaagatggctgggttaaacttgagggaacgtaccgttatagcagtgtaggcgatgagtttttaaccatttatgtagagagctcgaataatagcacagcctccttttatatcgatgatattacttttgaatcgactggttcgggtccgattgaagttgaggatttgacaccgataaaagatgtttatcaagacgatttcttaattggaaacgctgtctcagcttctgatcttgaaggcaatagacttaagcttctcaacatgcatcacaatgttgtcacagcagagaatgcaatgaagccagatcaagcgtataatgcggaaaaacaatttgactttactgatgaaaatgcgcttgtcgacaaggttttggatcagggattgcagctgcatggtcacgtgcttgtatggcaccagcagacgccagaatggttatttacagctgaaaacggtgcccctttgagccgtgaggcagcactagcaaatttaaggacccatgttaaaacagtcgtagaaaattacggtaacaaggtaatttcatgggacgtggtaaacgaagcaatcatcgataacccgccgaacccaacggattggaaggcatcacttcgtaaatctggctggtacaaatcgattggaccagacttcgtagaacaatccttccttgctgcaaaagaggtactgaatgaaaaaggcttgaatatcaagctatattacaatgattacaatgatgataatcagagcaaagccgaggccatttatcagatggtgaaagatatcaatgaaaagtatgctaaagaacatgatggggatcttctcattgacggaattggaatgcaagcgcactacaataaaaacactaatcctgaaaatgttaaactctccctagagaagtttattacattgggtgtagaagtcagtgtgactgaacttgacattaccgctggaaccaataatgtacttactgagaaggaagcaattgcacagggttatttatacgcacaattgttcaagatttacaaagaacacgcagagcatatctcacgggtaactttctggggactaaatgatgcaacgagctggagagctgcacagagtccattgttgtttgataaagatttgcaagcaaaaccagcttactatgctgttatcgatccagacacatttactgtagaaaatcaacctgaggtaagagaggctaatcaaggaagtgctgtttccggcacaccagtgattgatggaactgtagatggtgtttggagcaatgcaacggaactgccgattaatcgcttccaaatggcttggcagggagcaaacggggtatccaaggtcctctgggataatgaaaacctgtatgttttaattcaagtaagtgactcacagctcgacaaatcgagtccaaatccatgggaacaggattccattgaagtctttgtagatgagaataatgcaaagacatcttccttcgaagatggtgatggacaatatcgagtaaactttgacaatgaaacatcctttaaccctgtcagagttggagaaggtttcgaatctgcaaccaaagcatcaggtaatggctataccgttgaagtaaagattccgttcaaaaccattacaccagataacaatacgaaaatcggttttgatgttcagattaatgacggtaaagatggtgctcgtcaaagtgctgcaacatggaacgatttaactggtctgggatatcaggacacttctgtgttcggcgtcctgacacttatgaagactgacaccaccgcgcctgttacaaccgataacggaccagaagattgggttaataaagatgtaacgattgctttcagtgcaaatgataatgacactggtgtggcggcaacctattatagtattgataatggggtcgtacaaaacggtaattcagttactatttcggaagagggtgtccacattctaacatattggagtgtagacaaagctggtaatgtcgagcaggttcatacaaaaacaattaaactagataagaccggaccaatattagatattaaactcgacaaaacaacattatcaccagttaatcataagatggtcccaatatcggcggctattagtgcatctgatgccgattcaggaattcattcagtagtgttaacatcaattactagcaatgaatctatccaacctgatgatattcagaatgccaactataataaacctattacaggtactacggattcctttaaacttcgtgcagaaagattagcaaacggtaatggccgtgtttacaccattacttatacggccacagataaagctggtaatgtgacaacaaaaagtgttgaagtttccgttccacgcgacaattctaaaaaataa

SEQ ID NO: 74 - protein, 1484 aa, Unknown
  Obtained from an environmental sample
  SIGNAL (1)...(21)
MQKMRRKLKRIMLLLLAAMLIIPSGWITQASAAETNKDIPVLLYHRIVDNPTNQWTDTSVETFKQTMQYLNDSGYNTLSAEQYVKIMDGTATAPEKPILLTFDDGTPEFITNALPVLKQYNMKAVLFIVSDWIGGGFSMSKEQLQSLANEPSLSLENHTKTHDGTIWGTNGGVRSTITKEQAEDQIISANTYLKSITGKDPVLMAYPYGSYNDIAKLVNQENGIKYAFKVGYPNEDNYAMGRHYVTNQSVAQIAQMIGGPVPEPTPEPGNQTETVYQETFASDIGVAVQAGNPQVTHVSGMVFAGNDDGKAISVSGRTNNWDGVDIPFNNVGMENGKTYTITVTGYVDENATVPSGAQALLQNVDSYNGLYVAADYAAGQAFTLTGQYTVDTSKDRALRIQSNDAGKTVPFYIGNILITTKKTTAPETDRVVFHETFGNGVGVATQAGSAKLTPVSELVFEGNSDGKAISVNGRSNNWDGVDIPFSSVSMQNGKAYTITVTGFVYSSVSVPEGAQALLQNVDSYNGLYAAADVKAGQTFTLTGQYTVDTSKDRALRIQSNDAGKTVPFYIGDILITEKAASGGGGDDGRLPAEPFTAINFEDQNMGGFEGRAGTETLTVTNEANHTDGGSYALKVEGRSQAWHGPALHVEKYVDKDSEYKISAWVKLISPATSQLQLSTQVGNGGTASYNNLQGKTISTEDGWVKLEGTYRYSSVGDEFLTIYVESSNNSTASFYIDDITFESTGSGPIEVEDLTPIKDVYQDDFLIGNAVSASDLEGNRLKLLNMHHNVVTAENAMKPDQAYNAEKQFDFTDENALVDKVLDQGLQLHGHVLVWHQQTPEWLFTAENGAPLSREAALANLRTHVKTVVENYGNKVISWDVVNEAIIDNPPNPTDWKASLRKSGWYKSIGPDFVEQSFLAAKEVLNEKGLNIKLYYNDYNDDNQSKAEAIYQMVKDINEKYAKEHDGDLLIDGIGMQAHYNKNTNPENVKLSLEKFITLGVEVSVTELDITAGTNNVLTEKEAIAQGYLYAQLFKIYKEHAEHISRVTFWGLNDATSWRAAQSPLLFDKDLQAKPAYYAVIDPDTFTVENQPEVREANQGSAVSGTPVIDGTVDGVWSNATELPINRFQMAWQGANGVSKVLWDNENLYVLIQVSDSQLDKSSPNPWEQDSIEVFVDENNAKTSSFEDGDGQYRVNFDNETSFNPVRVGEGFESATKASGNGYTVEVKIPFKTITPDNNTKIGFDVQINDGKDGARQSAATWNDLTGLGYQDTSVFGVLTLMKTDTTAPVTTDNGPEDWVNKDVTIAFSANDNDTGVAATYYSIDNGVVQNGNSVTISEEGVHILTYWSVDKAGNVEQVHTKTIKLDKTGPILDIKLDKTTLSPVNHKMVPISAAISASDADSGIHSVVLTSITSNESIQPDDIQNANYNKPITGTTDSFKLRAERLANGNGRVYTITYTATDKAGNVTTKSVEVSVPRDNSKK

SEQ ID NO: 75 - DNA, 1122 bp, Unknown
  Obtained from an environmental sample
atgaaaaagcatattgtactcttcgcatttctttccgtgattttgctggcggcccgatcgtcggcgtcggagcgatttctcaaggacgtcttttcggattccttcaaggtcggcgtagccctcaatgccgatcagattacgggggcggactcggccagcctcgacttgtccttggctcacttcgattctcttgtcgctgaaaatgcgatgaagtgggggtcgctcaatcctgagccgggggtttacgatttccgggtggctgacgccctggtcgatttggcggagcgggaaggtttgtttttggttggccacacactgctctggcatcagcagacgccggactgggtttttctggacgagaagggcgagaccgccacgcgggagctggtgctcgctcgactggagacgcacatccgcaccgtggtcggccgctaccagggccgggtgcagggctgggatgtggtcaacgaagccttgaacgaagacggttcgttgcgggagtcgaaatggttgcagatcatcggcccggactacatcgaactggcgttccgcatggcgaaggaggccgatcccgacgccgagctttattacaatgactacaatgtgtccaagcccggcaagcgaggtggagtggtgcgcctgcttggagagctgcaggcgaaaggagttaaggtcgatgcggtcggcatccagggccactacagtctcgggcaccctgagctcgaccagctcgaggccagcatttctgcgataacggaggctggggctccgatcatgataaccgagctcgatgtgtcggtcttgccctttcccgacgcggagcaaatgggggcggacgtgtcgctcagctttgagatgcaggaccacctcaatccctatgccgatggcttgcccgaggcggtttcgcagcagctagctgaacgttacgcggccatttttgaagtgtttttgcgccaccagagccacatcgaccgcgtgacgttttggggagtgcacgacggggtcagctggtggaactattggccgatcgcgggcaggaccgactatcccttgctgtttgatcgggagctcaagcggaaagcggccttcgaggcggtggtcgatttagcggagggccgctga

SEQ ID NO: 76 - protein, 373 aa, Unknown
  Obtained from an environmental sample
  SIGNAL (1)...(22)
MKKHIVLFAFLSVILLAARSSASERFLKDVFSDSFKVGVALNADQITGADSASLDLSLAHFDSLVAENAMKWGSLNPEPGVYDFRVADALVDLAEREGLFLVGHTLLWHQQTPDWVFLDEKGETATRELVLARLETHIRTVVGRYQGRVQGWDVVNEALNEDGSLRESKWLQIIGPDYIELAFRMAKEADPDAELYYNDYNVSKPGKRGGVVRLLGELQAKGVKVDAVGIQGHYSLGHPELDQLEASISAITEAGAPIMITELDVSVLPFPDAEQMGADVSLSFEMQDHLNPYADGLPEAVSQQLAERYAAIFEVFLRHQSHIDRVTFWGVHDGVSWWNYWPIAGRTDYPLLFDRELKRKAAFEAVVDLAEGR

SEQ ID NO: 77 - DNA, 1248 bp, Unknown
  Obtained from an environmental sample
atgctaaaagttttacgtaaacctatcgtttctggattagctctagccttattattacctataggatcgacagttagtgccgaaacaaatatttcaaataaaccaggtattagcgggttaacagcaccacaattggaccaacgatataaagattctttcaccataggtgcagcggttgagccaaatcaattattagatgcaaaagactcacaaatgttaaagcgccattttaatagcattgtagcagaaaatgtcatgaagcctagcagtttacagccagtagaagggcagtttaactgggaaccggcagataaacttgttaagtttgcgaaagaaaatggaatggacatgcgcggccatacgcttgtctggcatagccaagtaccagattggttcttcaaagatgcaaatggaaattcaatggttgtttggcagaatggaaagcaagtggttgcagatccgtcaaatcttgaggctaacaaaaagcttttattaagccgtttagaaacacatgttaatacagtcgtttctcgttataaaaatgatattaaattttgggacgttgtcaatgaagtaatcgacgaatggggcggacatcctgaaggtttacgtcaatctccatggttcctaattaccggaacggactatattaaagtcgcttttgagacagcaagacaatatgctgctccagacgctaagctttatatcaatgattacaatacagaagtaacaccaaaaagaacgtacttatacaacctagtaaaaagtttaaaacagcaaggtgttccaattgatggtgttgggcatcagtctcacattcaaatcggctggccgtctgaaaaagaaattgaagacacaattaacatgtttgctgaactggggttagacaaccaaattactgagcttgatgtaagcatgtatggctggccagtaagggcgtatcctacctatgattctattccagcacagaaatttatagatcaagcagaccgatatgatcgtttatttaaattatatgagaaattaggcgataaaatcagcaatgtgacattctggggaattgctgataaccatacatggttaaatgaccgtgcagatgtttactatgatgcagatggaaacgttgtaacattggcaaatgcaccatatgctaaaatggaagctagatcaggtaaagatgcaccatttgtatttgatccagaatacaatgtaaaaccagcctattgggcgattatcgaccacaaataa

SEQ ID NO: 78 - protein, 415 aa, Unknown
  Obtained from an environmental sample
  SIGNAL (1)...(27)
MLKVLRKPIVSGLALALLLPIGSTVSAETNISNKPGISGLTAPQLDQRYKDSFTIGAAVEPNQLLDAKDSQMLKRHFNSIVAENVMKPSSLQPVEGQFNWEPADKLVKFAKENGMDMRGHTLVWHSQVPDWFFKDANGNSMVVWQNGKQVVADPSNLEANKKLLLSRLETHVNTVVSRYKNDIKFWDVVNEVIDEWGGHPEGLRQSPWFLITGTDYIKVAFETARQYAAPDAKLYINDYNTEVTPKRTYLYNLVKSLKQQGVPIDGVGHQSHIQIGWPSEKEIEDTINMFAELGLDNQITELDVSMYGWPVRAYPTYDSIPAQKFIDQADRYDRLFKLYEKLGDKISNVTFWGIADNHTWLNDRADVYYDADGNVVTLANAPYAKMEARSGKDAPFVFDPEYNVKPAYWAIIDHK

SEQ ID NO: 79 - DNA, 1293 bp, Unknown
  Obtained from an environmental sample
atgattggtctggatttgatttctggtggtcgtcgcaaggcctgtctggctgcctgtctggcgcttgccgcgctgtcattgccggtatcggctcaaatggctgcggggaaggaaaagttcgtgggtaacgtgatcgctggttatgtgcccggtgattacggcaatctctggaatcaggtgacgccggagaattccaccaagtggggagcggttgagtctacgcgtaatgtcatgaactggacgcaggctgatctggcctacaactacgccaagtccaagggcttcaagttcaagatgcacacgctggtatggggctcgcaagagccggcctgggtcaagaatctggatgcgacttcccagcgtgtcgaggtcgaacagtggatgcgtctgagctgcgaacgctaccccgattcctgggctatcgatgtggtgaatgaacccctgcatgccgtgccctcgtacaagaacgcactgggtggcgatggtgccaccggctgggattgggtcatcacctcgttccgtctggcgcgtcagtactgtccgcgcgccaagctgctgctcaatgagtacgccaccgagctggatgccagcaagcgcgccaagatcaagaccattgcctcgctgctcaagagtcgcggtctgattgatggtgttggcctgcaggcccatttcttcacgctggattacatgaatgccagccagatgaaggcggcactggatgattacgccacgctgggtgtggatatctacatttccgagctggatctgaagggcagtgccaataccgacgccagccagaaggcgaagtacgaagagctgttcccggtgatgtggaatcacgccagcgtgaagggcatcaccctgtggggctacaaggtgggtgaaacctggtcgagcggcaccggcctgctgaatgcgaacggtagcgagcgtccggccctgacctggctgaaaagctatatgagcagccgtcctgcagcatcgagcagcagttcttcgagtgtttcatccagcaaatccagttcgtcttcttctagccagtccagtgcctccagcagtgcaggcagtgcgccggtcttgtccggcaccagtgattacccgagcggtttcagcaagtgtgccgatctgggcggcacttgcagcgtgtcttccggcaccggctgggcggccttcgggcgcaagggtaagtgggttgccaaatacgtcggtgtgggcaagagcattccctgcacggtggcggcgtttggtcgtgacccggggggcaatcccaacaagtgttccttccagaggtaa

SEQ ID NO: 80 - protein, 430 aa, Unknown
  Obtained from an environmental sample
  SIGNAL (1)...(36)
MIGLDLISGGRRKACLAACLALAALSLPVSAQMAAGKEKFVGNVIAGYVPGDYGNLWNQVTPENSTKWGAVESTRNVMNWTQADLAYNYAKSKGFKFKMHTLVWGSQEPAWVKNLDATSQRVEVEQWMRLSCERYPDSWAIDVVNEPLHAVPSYKNALGGDGATGWDWVITSFRLARQYCPRAKLLLNEYATELDASKRAKIKTIASLLKSRGLIDGVGLQAHFFTLDYMNASQMKAALDDYATLGVDIYISELDLKGSANTDASQKAKYEELFPVMWNHASVKGITLWGYKVGETWSSGTGLLNANGSERPALTWLKSYMSSRPAASSSSSSSVSSSKSSSSSSSQSSASSSAGSAPVLSGTSDYPSGFSKCADLGGTCSVSSGTGWAAFGRKGKWVAKYVGVGKSIPCTVAAFGRDPGGNPNKCSFQR

SEQ ID NO: 81 - DNA, 1017 bp, Unknown
  Obtained from an environmental sample
ttgaccacgagagctattcgcacggaggcagcgctgaaggagatgtttgcggaggactttcagatcggagccgctgttaatccgatgactatacggacacaggaggagctgcttgcttatcacttcaacagtattacggcagagaatgaaatgaagtttgccagtctgcagccggaggagggggcttatgcttttgacgaggcggatcgattggcggccttcgcccggaagcatggcatggcgatgcggggacacactttagtgtggcataaccagtccacaggctggctgttcgaagacaagcagggaaatcctgtagataaggcaactctgctggagaggctgaaatcgcacatccatacggtagtaggacgttataaaaacgatatttatgcttgggatgtggtaaacgaggttatagaggacgagggagacggcctgctgcgccggtcgaaatggctggatattgccggaccggaattcattgcccgggcgttcgagtatgctcatgaggctgaccctaatgcgctgctcttctataatgactacaacgagtccaatccggcgaagcgagacaagatccatgctctggtgaagtcgctgctggagcaaggcgtgcctattcatggcattggactgcaggcgcattggaatttgtatggtccttctctcggcgagatccgagcggcactggagaagtatgcttctcttggcctgcagctgcagcttacggagctggatatgtcgctgtttcgttttgacgacaagcgtacggatataaccgagcctccggcggaattgcttgagctgcaggctgagcggtatgaggaaattttcaagctgctgagggaataccgggatgtaatcacttccgtgaccttctggggggctgcggatgattatacgtggctgaacgattttcccgtccgggggcggaaaaattggcctttcctgttcgatgagcagcatcaccccaaactggcatttcatcgggtcgctgcactttcccgccagtga

SEQ ID NO: 82 - protein, 338 aa, Unknown
  Obtained from an environmental sample
LTTRAIRTEAALKEMFAEDFQIGAAVNPMTIRTQEELLAYHFNSITAENEMKFASLQPEEGAYAFDEADRLAAFARKHGMAMRGHTLVWHNQSTGWLFEDKQGNPVDKATLLERLKSHIHTVVGRYKNDIYAWDVVNEVIEDEGDGLLRRSKWLDIAGPEFIARAFEYAHEADPNALLFYNDYNESNPAKRDKIHALVKSLLEQGVPIHGIGLQAHWNLYGPSLGEIRAALEKYASLGLQLQLTELDMSLFRFDDKRTDITEPPAELLELQAERYEEIFKLLREYRDVITSVTFWGAADDYTWLNDFPVRGRKNWPFLFDEQHHPKLAFHRVAALSRQ

SEQ ID NO: 83 - DNA, 3024 bp, Unknown
  Obtained from an environmental sample
atgaaaaccaaaaggtctatattcaggttgtctatcctggttgtcctggctgtgctgctgttcagcgcaatcaccttgacagccagcgccgccgacacgctcggcgcggcggcggcccagtcgggccggtacttcggcacggcgatagctgccggcaagctcggcgactcgacctacacgaccattgccaaccgtgagttcaacatgatcacggctgagaatgagatgaagatcgacgccaccgagccgaaccagaaccaattcaacttcaccaacgccgaccggatcttcaactgggcggtgcagaatgggaagcaggtgcgcgggcacacgctggcatggcactcgcagcagccggggtggatgagcagcatgagcggcaccgcgctgcgcaatgcgatgatcaaccacatcaatggggtgatggcccactacaagggcaggatctacgcctgggatgtggtgaacgaggctttcaacgaggacggcagccgccgcaactcgaacctgcagcagaccggcaacgactggatcgaggtggccttccggacagcccgcaccgccgacccggccgccaagctgtgctacaacgactacaacatcgaagcctggagctatgccaagacgcagggcgtttaccggatggtccaggacttcaagtcccgcggcgtgccgatcgactgtgtcgggttccagagccacttcaacagcggcacttcctacgtcaacagcaacttccggacgacgctgcaaagcttcgccgcgctgggcgtggacgtgcagatcaccgagctggatgtcgagaatgccgactcgcggctcgattggtggagaggcatcgtcaatgactgcctggcggtcccgcgctgcaacggcatcacggtgtggggcgtgcgcgacagcgattcgtggcgctcttcgcagaacccgctgctgttcaactccagcggtggtaagaaggcttcgtacaccgccgtcctcgacgccctcaacgctgccccgaccgtcacacctccggtaacgacacctccggtgacgacaccgccagtgaccacgcctcctcccggcactgtgtcgattaacgcgggcggctcggcgagcggcagcttcacggccgaccagtacttcagcggtggcagcacctacaccaacaccgccaccatcgacatgagtcagatcaccagcaacccaccgccggcggcggtcttcaacagcgagcgttacggggcgatgacctacaccatccccaaccgctcgggtgctcagacggtgacgctgtactttgccgagacctacctcaccgcggcagggcagcggtcgttcaacgtgtcgattaatggcgcagcggcgctgtccaacttcgacatctatgcctcggcaggtggcgctaaccgggccatcgcccggacgttcagcaccacggctaactcaagtggccaggtggtgatccagttcacggcggttaccgagaaccccaagatcaacgctatcacggtaacagcgggtggcacgcctccaccgacaacgcctccgcccaccacgccgccaccgaccacccctccggtgacgacacccccagtgacgacacccccagtgacgacaccgccccccggcagcgtgtcgatcaacgcgggcggctcggccaccggcagcttcacgggcgaccagtactttagcggtggcagcacctacaccaacaccgccaccatcgacatgagccagatcaccagcaacccaccaccggcggcggtgttcaacagcgagcgctacggggcgatgacctacaccatccccggccgctcgggggctcagacggtcacgctttactttgccgaaacgtatgtcactgcggcagggcagcgcgtctttaacgtgtctgtaaacggcgcggcagcgctgtccaacttcgacatctatgccagcgccggcggccagaaccgggccatcgctcgctccttcaacaccacggccaactcaagcggccaggtggtgatccagttcacggcggtcaccgagaaccccaagatcaacgccatcactgtggcgggcgggatcggggacttccaaaccctgaccgtcacgaagtccggcacggggacggtcacctccaacccggctggtatcaactgcggctcgacctgcaacgccagcttcgctaccggcaccagcgtgaccctgaccgcctccggcgggaccttcaccggctggagcggagcctgctccggcacctccaccacctgcaccgtctccatgacccaggcccggtcggtcaccgctacttttagcggcggtggtgacaccaggccgagcgcggggtgtggtaagaaccggacactgcagaatggcacaatcaccatttcaagtggcggcgtcaaccgcacctacatcctacgcacgcctgacaactacaacaacacgcatgcataccggctgatcatggcttatcactggcttaacggcagcgcgcagaatgtggcgagcgagaactactaccggctgttcccactctccaacaacagcaccatcttcgtggcgcctcaggggctggatgccggatgggctaacaccaacaaccgcgacctgaacctcaccgatgccatactcacccaggtcgagaacgatctgtgcgtcgacttgaaccgggtctgggccaccgggttcagctacggcgcaggtatgtcatacgccatcgcctgtgccagggccaatgtgttccggggcgtcgctctctatgccggcgcgcagctcagcggttgcaccggtggaaccacggccattgcgtacttcgcaacgcacggcatcaacgacagtgtcctcaacatctcgcaagggcggactctacgcgaccgctttgtctcgaacaacagctgcacggcgcagaaccctcccgagccttcctcgggcagcgggacgcacatctgcacgtcctaccagaactgctcggcaggacatcctgtccggtggtgcgcgttcgacggcgaccacaccccgaatcagaccgaccgcggccagagcacaagctaa

SEQ ID NO: 84 - protein, 1007 aa, Unknown
  Obtained from an environmental sample
  SIGNAL (1)...(30)
MKTKRSIFRLSILVVLAVLLFSAITLTASAADTLGAAAAQSGRYFGTAIAAGKLGDSTYTTIANREFNMITAENEMKIDATEPNQNQFNFTNADRIFNWAVQNGKQVRGHTLAWHSQQPGWMSSMSGTALRNAMINHINGVMAHYKGRIYAWDVVNEAFNEDGSRRNSNLQQTGNDWIEVAFRTARTADPAAKLCYNDYNIEAWSYAKTQGVYRMVQDFKSRGVPIDCVGFQSHFNSGTSYVNSNFRTTLQSFAALGVDVQITELDVENADSRLDWWRGIVNDCLAVPRCNGITVWGVRDSDSWRSSQNPLLFNSSGGKKASYTAVLDALNAAPTVTPPVTTPPVTTPPVTTPPPGTVSINAGGSASGSFTADQYFSGGSTYTNTATIDMSQITSNPPPAAVFNSERYGAMTYTIPNRSGAQTVTLYFAETYLTAAGQRSFNVSINGAAALSNFDIYASAGGANRAIARTFSTTANSSGQVVIQFTAVTENPKINAITVTAGGTPPPTTPPPTTPPPTTPPVTTPPVTTPPVTTPPPGSVSINAGGSATGSFTGDQYFSGGSTYTNTATIDMSQITSNPPPAAVFNSERYGAMTYTIPGRSGAQTVTLYFAETYVTAAGQRVFNVSVNGAAALSNFDIYASAGGQNRAIARSFNTTANSSGQVVIQFTAVTENPKINAITVAGGIGDFQTLTVTKSGTGTVTSNPAGINCGSTCNASFATGTSVTLTASGGTFTGWSGACSGTSTTCTVSMTQARSVTATFSGGGDTRPSAGCGKNRTLQNGTITISSGGVNRTYILRTPDNYNNTHAYRLIMAYHWLNGSAQNVASENYYRLFPLSNNSTIFVAPQGLDAGWANTNNRDLNLTDAILTQVENDLCVDLNRVWATGFSYGAGMSYAIACARANVFRGVALYAGAQLSGCTGGTTAIAYFATHGINDSVLNISQGRTLRDRFVSNNSCTAQNPPEPSSGSGTHICTSYQNCSAGHPVRWCAFDGDHTPNQTDRGQSTS

SEQ ID NO: 85 - DNA, 1254 bp, Unknown
  misc_feature: Bacterial DNA
atgaccttgattacgccaagctcgaaattaaccctcactaaagggaacaaaagctggagctcgcgcgcctgcaggtcgacactagtggatctcacactttacttcgagtctcagaatccgaccctcgagttctacgtggacgatgtgaaggtagtggacaccacctctgctgagataaaactcgagatgaatccagaagaggaaataccagccctcagggaagttctgaaagactacttcagagtgggcgttgctcttccatccaaggtattcatcaaccagaaggacttaacgctcatcaccaagcacttcaacagcatcaccgcagaaaatgagatgaaacctgatagtctgcttgcaggcattgagaatggcaaactcaagttcagatttgaaacagcagacaaatacatcgaatttgcacagcaaaacggcatggttgtgaggggccacacactggtatggcacaatcagacgcccgagtggttcttcaaagacgaaaatggaaacctcctctccaaagaagcgatgacagaaagactcagagaatacatacacaccgtcgttggacacttcaaagggaaggtctacgcatgggacgttgtgaacgaagcggtcgatccgaaccagccagatggactgagaagatccacctggtatcagatcatggggcctgactacatagaacttgccttcaagtttgcaagggaggcagatcccgatgcgaaactcttctacaacgactacaacaccttcgaacccaaaaagagagacatcatctacaaccttgtgaagagtctcaaggaaaagggtctcatcgatggaatcggtatgcagtgtcacatcagtcttgcaacggacatcaggcagatcgaagaggccatcaaaaagttcagctccatccctggtatagaaatccacataacagagctcgatatgagcgtctacagagattctacttccaactacccagaggcaccgaggaacgcactcattgaacaggctcacaagatggctcaactctttgaaatcttcaagaaatacagtaatgtgatcacaaacgtcacgttctggggtctcaaagacgactactcctggagagcaacaagaagaaatgactggacattgatctttgacaaagattatcaggcaaaactcgcttactgggcgattgtcgctcctgaagtgctaccacctctttcaaaagaaagcaagatccaaagaattcaaaaagcttctcgagagtacttctag

SEQ ID NO: 86 - protein, 417 aa, Unknown
  DOMAIN (1)...(417): Bacterial protein
MTLITPSSKLTLTKGNKSWSSRACRSTLVDLTLYFESQNPTLEFYVDDVKVVDTTSAEIKLEMNPEEEIPALREVLKDYFRVGVALPSKVFINQKDLTLITKHFNSITAENEMKPDSLLAGIENGKLKFRFETADKYIEFAQQNGMVVRGHTLVWHNQTPEWFFKDENGNLLSKEAMTERLREYIHTVVGHFKGKVYAWDVVNEAVDPNQPDGLRRSTWYQIMGPDYIELAFKFAREADPDAKLFYNDYNTFEPKKRDIIYNLVKSLKEKGLIDGIGMQCHISLATDIRQIEEAIKKFSSIPGIEIHITELDMSVYRDSTSNYPEAPRNALIEQAHKMAQLFEIFKKYSNVITNVTFWGLKDDYSWRATRRNDWTLIFDKDYQAKLAYWAIVAPEVLPPLSKESKIQRIQKASREYF

SEQ ID NO: 87 - DNA, 1089 bp, Unknown
  Obtained from an environmental sample
ttgaagaacagaattaaaaaggttgtgggcgggctcgccctggcgagtgttctgctcacctcggtaatggcaggcaatgccagcgcagcaattaccaatggatcgaagttcctggggaatatcattgccggcagtgctccaagtaacttcaccacctactggaatcaggtcaccccggagaacggcaccaaatggggttccatcgaaggcaaccgcaaccagatgaactggggaaacgcggacatgatctataactacgccatcagcaaaaacatcccgttcaaattccatactctcgtctggggaagccaggagcccaactgggtggccggcttgtcggcagcggagcagaaggcggaaatcagctcattcattactcaagcaggacagcgttattccgcgaagacagcttttgtggatgtagtcaatgaaccgctgcatgccaagccttcgtaccgcaatgccatcggcggcgatggcagcaccggctgggattgggtgatctggtctttccagcaagcccgggccgccttcccgaacgccaagctgcacctcaatgactacggcattatcggtgaccccagcgcggccgataaatatgtgaacattatcaatatcctgaaatccagaggactgatcgatggtattggtattcagtgccactacttcaatatggataacgtaagtgtgagcaccatgaatactgtactgggtaagcttgctgcaacaggcctgccaatctatgtctccgagctggatattaccggtgatgacaacacccagcttgccagataccaacagaaattccctgtgctctggaaccatccttccgtgaagggcgtcaccctgtggggctacatccaaaatcagacctgggcatcaggcacccatctggtgaattccaacggcacagagcgccctgccctgaagtggctgaagcaatacctgggcggctcgtcagctctgatggaaaccacagacgcccaagacctcactatcactgacagtctgatccagccggacagtgtggttgagccggaccctcaactggatctccagccggtgcttgagcccgttccggctgagtaa

SEQ ID NO: 88 - protein, 362 aa, Unknown
  Obtained from an environmental sample
  SIGNAL (1)...(29)
LKNRIKKVVGGLALASVLLTSVMAGNASAAITNGSKFLGNIIAGSAPSNFTTYWNQVTPENGTKWGSIEGNRNQMNWGNADMIYNYAISKNIPFKFHTLVWGSQEPNWVAGLSAAEQKAEISSFITQAGQRYSAKTAFVDVVNEPLHAKPSYRNAIGGDGSTGWDWVIWSFQQARAAFPNAKLHLNDYGIIGDPSAADKYVNIINILKSRGLIDGIGIQCHYFNMDNVSVSTMNTVLGKLAATGLPIYVSELDITGDDNTQLARYQQKFPVLWNHPSVKGVTLWGYIQNQTWASGTHLVNSNGTERPALKWLKQYLGGSSALMETTDAQDLTITDSLIQPDSVVEPDPQLDLQPVLEPVPAE

SEQ ID NO: 89 - DNA, 2541 bp, Unknown
  misc_feature: Bacterial DNA
atggatacattgttcaatacaaccgatgagcgtggggcgtccaagcgccgtggcatcgtcgcggcgcttgcggccgcagccatgctggtgccgctggcgttcgccccgacggccatggcggccgaccccgactatccgggcggcatcaagggcgaatacaatccgctgggaatcaacgctggtgtcgccatcgagacatacaccctcaaccaggacaaggagaaggccctggtcgagaacttcgaccagatcaccccggagaactcgctgaagccggaaggctggtacgacgaccagcataatttccgcatgtcggatgacgcgcggaacctgctgacgttcgccagcgagaacggcatcaaggtctacggccatgttctggtctggcactcgcagacgcccgactggttcttccaggccgacgaatggtgccatgacaccaacgacaaccccggcgtcaccagctgcccgcttgccgacaaggccacgatgcaggaacgccagcgcaggcacatcgagaacgtggcggaggccatctccgacgaattcggaaaattcggcagcccgaccaatcccgtcgtcgcgttcgacgtggtcaacgagaccgtgaacgacagcgacgaccccgccaccaacggcatgcgcaattcgctgtggtatcagacctatgggggcgaggactacatctatgacgcgttccggaacgcgaatacgtatctgaacgacgtctacgccgccgacgacgcggagcatccggtgacgttgttcatcaacgattacggcaccgagcaggcgggcaagcgttcccgctacaaggcgcttctggaacgcatgatccagcagggggttccctttgacggcatcggtcaccagttccatgtgtcgttgaccacggcctcgtcgaatctcgacgacgcgctgaccgatatgtcctcgctcggcaagaagcaggccatcaccgaactggacgtcgccaccggaacgccggttacggaggcgaagctcatcgagcagggacggtactactacgacgtcaaccagatcatccacaggcacgccgaccagctgttctcggtttcggtgtgggggctgagcgacgaccagtcctggcgcaacaaggagggcgcgccgctgctgttcgacgacaacctggagaagaagccggcgtacatcggctacatcggtgatagcgccaaccttcccgagccgttgaagagcatgaacgcattcaaggatgacgccgtgggcatcgactcggcgcttcccggtaccgtggccgagtccggcgcgtcctctccgtgggaacgtctttcgctggtcgagatgaccccgtctgcgtatgacgccgtttccggctcgttcaatgtctattggaaggacggctctctggtcgtctacgcggatgtcgccgatgccagcgcggcggatgacgacaccgtcaccgtgcgtgtgggtgacgccgagtatacgatcggccgcaacggtgtgaccggcggcgagggtgtgcaggccaacgtcgtttcgtctgatgccggatacgaagtcgtggccgatatcccgtacaccggtgcagagaaggacatcgtcgagatgaacgtcatcgcgacggattccgccaccacggagaccagcgcgtggagcacgaacgacactggcgccgtcacgctggccgagccgctgagctacacggaagccgtgaaggttcccgccgacgcccaggctccggtcgttgacgccgacccgtcggattccgtctgggcggaagccaacgaggttcccgtgggtaaggtgaccgccgccacgccttcccccgaggcgaccgctaccgccaagaccctgtggtcggacggcaagctgtatgtcctcatggaagtgaccgacgcggacatcgatctgaccaactcgaatccgtgggagaaggactccgttgaggtgtacatcgaccgtggcaacaccaagagcggccagtataccaacgacatccagcagattcgcgtgtccgccgatggtgcggagctgagcttcggctccggcgcgtcggaggatgtccagaagtccatggtccagaccgccggcaagctcgtcgatggcggctatgtcgtcgagatggccatcgatctgggaacggctgaggccggcaccttcgaaggtgtcgacttccagatcaacgacgcgaagaacggtgctcgaatcggcatccgcaactgggccgatccgaccggtgccggctatcagacggcgtcccattggggcgtgctgcgtctgctggccgatccctccgaaaccgagaccccgggtggagaagatcccgagacccccggtgacgaggagactcctggcgaggataccgagaagcctggcgacgaggaaacccccggtgaggataccgagaagcctggcgacgagaagccgcggccttccgacgatgctgacaacgacgacaagatgccgcagaccggttccgcggtcatcggaatcgccgtggtggcgctgctgctggttgccgccggatgcgggctggtcatcgctcggcgtcgatga

SEQ ID NO: 90 - protein, 846 aa, Unknown
  DOMAIN (1)...(846): Bacterial protein
  SIGNAL (1)...(40)
MDTLFNTTDERGASKRRGIVAALAAAAMLVPLAFAPTAMAADPDYPGGIKGEYNPLGINAGVAIETYTLNQDKEKALVENFDQITPENSLKPEGWYDDQHNFRMSDDARNLLTFASENGIKVYGHVLVWHSQTPDWFFQADEWCHDTNDNPGVTSCPLADKATMQERQRRHIENVAEAISDEFGKFGSPTNPVVAFDVVNETVNDSDDPATNGMRNSLWYQTYGGEDYIYDAFRNANTYLNDVYAADDAEHPVTLFINDYGTEQAGKRSRYKALLERMIQQGVPFDGIGHQFHVSLTTASSNLDDALTDMSSLGKKQAITELDVATGTPVTEAKLIEQGRYYYDVNQIIHRHADQLFSVSVWGLSDDQSWRNKEGAPLLFDDNLEKKPAYIGYIGDSANLPEPLKSMNAFKDDAVGIDSALPGTVAESGASSPWERLSLVEMTPSAYDAVSGSFNVYWKDGSLVVYADVADASAADDDTVTVRVGDAEYTIGRNGVTGGEGVQANVVSSDAGYEVVADIPYTGAEKDIVEMNVIATDSATTETSAWSTNDTGAVTLAEPLSYTEAVKVPADAQAPVVDADPSDSVWAEANEVPVGKVTAATPSPEATATAKTLWSDGKLYVLMEVTDADIDLTNSNPWEKDSVEVYIDRGNTKSGQYTNDIQQIRVSADGAELSFGSGASEDVQKSMVQTAGKLVDGGYVVEMAIDLGTAEAGTFEGVDFQINDAKNGARIGIRNWADPTGAGYQTASHWGVLRLLADPSETETPGGEDPETPGDEETPGEDTEKPGDEETPGEDTEKPGDEKPRPSDDADNDDKMPQTGSAVIGIAVVALLLVAAGCGLVIARRR

SEQ ID NO: 91 - DNA, 1023 bp, Unknown
  Obtained from an environmental sample
atgaatgtatcggtaccggccgagtccgcacttaaagacatcttcgcggaagacttccatataggtgcggcggtcagtagtaatacgatcaagtcgcaggagagtctgcttacgcatcactttaacagcattacggcggaaaacgaaatgaagttcgccagcgtccatccagaggaagagctttacaccttcgaggaagcggatcagatcgtggacttcgcgcgcaaacacgggatggctgtccgcggacatacgctggtatggcataaccagaccaccgattggttgttccgcgacaagcagaatcagctcgtgagcaaagccgtgctttatgaaagaatccgttcgcatatccaaacggtagtaggcagatataagggcgatatttacgcttgggacgttgtgaacgaggtcattgccgatgacggcgatcagttgctgcgtacctccagctggacggaaatcgccggggacgaattcatcgccaaagcgtttgaatacgcgcatgctgccgacccgaatgcgctgttgttctacaacgactacaatgagtcccatccaagcaaacgggataaaatttataccttggtcaagtctcttctggaccggggagtacctattcacggcattggcctgcaggcacactggaatctgttcaacccgtccttggatgacatccgggcagccatcgaaaaatatgcttcgctaggattgcagctccagctcacggaactggatgtgtcggtattccgtttcgaagataagcgggccgatctgaccgagcctgaaccgggaatgctggaacagcaggctgaattctacgaagccgtgttcaagctgcttaaggaatacagcgatgtaattagcgcggtgacgttctggggagctgcggacgaccacacctggctcagcgattttccggtacgtgggcgcaaaaactggccgctgctgttcgatgagcggcacaggccgaagccggcatattatcgcttagctgctcttgccaatcatcttcggcgttga

SEQ ID NO: 92 - protein, 340 aa, Unknown
  Obtained from an environmental sample
MNVSVPAESALKDIFAEDFHIGAAVSSNTIKSQESLLTHHFNSITAENEMKFASVHPEEELYTFEEADQIVDFARKHGMAVRGHTLVWHNQTTDWLFRDKQNQLVSKAVLYERIRSHIQTVVGRYKGDIYAWDVVNEVIADDGDQLLRTSSWTEIAGDEFIAKAFEYAHAADPNALLFYNDYNESHPSKRDKIYTLVKSLLDRGVPIHGIGLQAHWNLFNPSLDDIRAAIEKYASLGLQLQLTELDVSVFRFEDKRADLTEPEPGMLEQQAEFYEAVFKLLKEYSDVISAVTFWGAADDHTWLSDFPVRGRKNWPLLFDERHRPKPAYYRLAALANHLRR

SEQ ID NO: 93 - DNA, 1011 bp, Unknown
  Obtained from an environmental sample
atgaatcaatcagtaaatgaagcacaggttcctgcattatcggatgtatatgaagattatttttcaataggtgccgctgttaatccacttactttaggtacgcaaaaaaagctgttaaccaaacattttaatagtataacggctgagaatgaaatgaaatttgaagcattacagcctaaaccagatcaatttacatttgatacggcggataaaatggttgcctttgcccaagcacatgatatgaagatgcgtggccatacattaatctggcacaatcaaacaccagattggatgtttttgcaaaaagacggtacgacaattgatcgtgaaacactcttggagagaatgaaaaaacatattaagacggtggtggaaagatataaaggcaaaatatattgttgggacgttgtaaatgaagcggtagctgatgaaggcgaagctattttaagaccatcaaaatggacggacattattggcgactcgtttattgagtatgcttttaaatacgcccacgaggccgatcccgatgcactgttgttttacaatgactacaatgcttgccaccctcataaaagagataagatttatcaacttgtaaaggggttaatagacaagggtgtgcccatacacggtattggcctacaagcacattggaacattgttgacccgtcttacgatgatattaaacgagccatcgaaacttatgcatcattaggattaagcatacactttactgaaatggatgtgtctgtttttgaatatcatgatcgaagaacagacttattggaacctacaaaagatatggtttcacgtcaagctgagcgttatcaggcattttttgaaatatttaggtcgtatgctgatgtgattgattccgttacgttttggggcatggccgatgattatacatggcttgatgattttccggtgacaggtcgaaaaaattggccctttgtatttgatgcgagacatcagcctaaaacagcattctggaacatcgttgatttttaa

SEQ ID NO: 94 - protein, 336 aa, Unknown
  Obtained from an environmental sample
MNQSVNEAQVPALSDVYEDYFSIGAAVNPLTLGTQKKLLTKHFNSITAENEMKFEALQPKPDQFTFDTADKMVAFAQAHDMKMRGHTLIWHNQTPDWMFLQKDGTTIDRETLLERMKKHIKTVVERYKGKIYCWDVVNEAVADEGEAILRPSKWTDIIGDSFIEYAFKYAHEADPDALLFYNDYNACHPHKRDKIYQLVKGLIDKGVPIHGIGLQAHWNIVDPSYDDIKRAIETYASLGLSIHFTEMDVSVFEYHDRRTDLLEPTKDMVSRQAERYQAFFEIFRSYADVIDSVTFWGMADDYTWLDDFPVTGRKNWPFVFDARHQPKTAFWNIVDF

SEQ ID NO: 95 - DNA, 1143 bp, Unknown
  Obtained from an environmental sample
atgaaaaaaacgattgcacatttcaccttatggatagtgttttttctcttcacttcctgtgctgttacggcgcagaagaatgctaagaatacaagagtaaaactcactaccctaaaagaggcttaccaaggtaaattctatatcggtactgcgatgaatctgagacagattcacggagatgatccccagtctgaaaatattatcaaaaaacagttcaattccatagttgccgaaaactgcatgaagagtatgtatcttcagccggaggaaggaaaatttttcttcgatgatgcggacaagtttgtggattttggtcttcagaacaatatgttcatcatcgggcattgtctgatttggcattcgcaggcgccaaaatggtttttcaccgatgagaatggaaaaacggtttccccagaagttcttaaacaaaggatgaaagcccatatcaccgctgtcgtttcccgctacaaagggaaaatcaaaggttgggatgtggtgaacgaagccattatggaagatggttcttaccgcaaaagcaaattttatgagattttgggagaagaatttattccgttggcatttcagtatgcgcatgaagcagatcctgatgcagaactttattacaacgattataacgaatggtatcccggaaaaagagctacggtgaccaagataatccgcgatttcaaatctagaggaatccgcattgatgccatcggaatgcaggctcatttcgggatggattcgcccactttagaagagtatgaacaaaccattcagggctatataaaagaaggcgtgaaagtcaatattacggaactcgatttgagtccgcttccttctccttggggaacttccgccaatgttgccgatacgcagcagtatcaggaaaaaatgaatccttacaccaaaggacttcccgccgatgtggaaaaagcatgggaaaaccgctatctcgattttttcaaactgttcctgaaatatcatcagcatatcgagcgtgttacgttttggggcgttagcgatatcgattcctggaagaacgattttccagtaagaggacgtaccgattatccactaccgtttaaccgacagtatcaggcaaaacctttggtgcagaaattaatagacttaacgaaatag

SEQ ID NO: 96 - protein, 380 aa, Unknown
  Obtained from an environmental sample
  SIGNAL (1)...(24)
MKKTIAHFTLWIVFFLFTSCAVTAQKNAKNTRVKLTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGKTVSPEVLKQRMKAHITAVVSRYKGKIKGWDVVNEAIMEDGSYRKSKFYEILGEEFIPLAFQYAHEADPDAELYYNDYNEWYPGKRATVTKIIRDFKSRGIRIDAIGMQAHFGMDSPTLEEYEQTIQGYIKEGVKVNITELDLSPLPSPWGTSANVADTQQYQEKMNPYTKGLPADVEKAWENRYLDFFKLFLKYHQHIERVTFWGVSDIDSWKNDFPVRGRTDYPLPFNRQYQAKPLVQKLIDLTK

SEQ ID NO: 97 - DNA, 1407 bp, Unknown
  Obtained from an environmental sample
atgaatgaaacctcgcggaattggttggagagaggattgcctttcgaacgccaacggcgttccaacattcagcccagggttggcgcttgcgcctaccctgggttggaagcaatcgctccatcaaccctgaaagggttgcagcggaggtttgcacaagaccgatacaaccctttcaggattggctttctcccttttccacccagggtagcgcctgcggcgcaaccctgggctgatggatcagaacgccgttggcgttcccggaaacctgcgaagaaacaactcgccttcctggccatcaccagtctcctctcgggtctgctgtggggcgccgaagtgcaaccggcactgaaagacgtattccgccaggacttcctgctgggggcggcgttgaacgcggagcaggtgctggacaccaaccgggtcgagtcggtattgatcgaaaagcatttcaacacgatcacgcccgagaatgtgctgaagtgggaacgagtccatcctcagcccaaccagtattcttttgaggacgcggatcgctacgtcgagttcggccgcaaacacggaatggtcatcatcggccacacgctggtctggcacagccagacgcccggctgggtcttccgggatgccgacggaaagacgctgacgcgcgaagccctgctggagcggatgcgcgaccacatccacaccgtggtcgggcgctacaagggcaagatccgcggctgggatgtggtgaacgaggcgctgcgcgacgacggcgcgtggcggaattcccaatggcggcggatcatcggcgacgattacattttgaaagccttccagtatgcccatgaggccgatccggatgcggagctctattacaacgattattcgctggagaagccggccaagcgcaatggcgccgtggacctggtgaagcagctccaggccggcggggcgaagctggccggcgtcggcttgcaggggcactacaacctcgactggccggagaccgccgagatcgaaaacaccatcgcggcgttcgcggagctggggctcaaggtgatgatcacggagctggacgtcaacgcgctgccgacgcccggccagtcgggcgaagccgatgtagggatgacgttcggcggcaatttcggcggcgataaatggaatcctttcacgaacggactgccggccgcagtggagcaacgcctcgcggaccgctacgctgaaatcttcaggatcttcacgaagcacagccgtcggatttcgcgcgtcaccttctggggcgtcaccgaccggacctcctggctcaacaattttcccatccgcggccggaccaattacccgttgctctttgatcgggctggggagcccaaacccgcgttccgatccgtcgtggcggtccgtcagccgcgccagcccgtcgaatga

SEQ ID NO: 98 - protein, 468 aa, Unknown
  Obtained from an environmental sample
MNETSRNWLERGLPFERQRRSNIQPRVGACAYPGLEAIAPSTLKGLQRRFAQDRYNPFRIGFLPFPPRVAPAAQPWADGSERRWRSRKPAKKQLAFLAITSLLSGLLWGAEVQPALKDVFRQDFLLGAALNAEQVLDTNRVESVLIEKHFNTITPENVLKWERVHPQPNQYSFEDADRYVEFGRKHGMVIIGHTLVWHSQTPGWVFRDADGKTLTREALLERMRDHIHTVVGRYKGKIRGWDVVNEALRDDGAWRNSQWRRIIGDDYILKAFQYAHEADPDAELYYNDYSLEKPAKRNGAVDLVKQLQAGGAKLAGVGLQGHYNLDWPETAEIENTIAAFAELGLKVMITELDVNALPTPGQSGEADVGMTFGGNFGGDKWNPFTNGLPAAVEQRLADRYAEIFRIFTKHSRRISRVTFWGVTDRTSWLNNFPIRGRTNYPLLFDRAGEPKPAFRSVVAVRQPRQPVE

SEQ ID NO: 99 - DNA, 1074 bp, Unknown
  Obtained from an environmental sample
gtgcgctcaagagctagcgcgtactggttcggcgtggggttggtggtggcgctgagcctggctcagaccccttccccccagtccctgcgcgcgctggccgagcgccaggggctgctggtgggagccgcggtggacctagcggccctgtacgaccccctcgagcccgagtacgcccaactcctcgcccgcgagttcaacctggtggtggccgagaacgccatgaagtgggcctccctgagcaacgcgcgggggcagtacagcttcaccggcgctgacgccctggtgcgcttcgcccgccagcacggccagcgcttgcgcggccacaccctcatctggcacgagcaactgcccgcgtgggtgcgcagcggcaccttctcccgcgaggccatgctggcggtgatgcaggagcacattcaggcggtggccgggcacttccgcggccaggtggcctactgggacgtggtcaacgaggcggtgagtgaccggggcggcctgcgcgagaccccctttctgcgggcggtgggccccgactacctcgagcacgccttccgcttcgcccgcgccgccgacccccaggccaagctcttctacaacgactacggcgccgacggcatgggcgctaaatcggacgagatctacgccctgctcaaagcgctcaaggccaagggggtacccgtcgacggggtgggcttccaggcccacctcgacagcaccttctcggtccagcaggcgcggatgcgggagaacctagagacgcttcgccgacctgggcctcgaggtgcacatcaccgagctggacgtgcagctaaaaggggcgggctcgcgggaggaacggctggaggcgcaggcccggatctacgccgaggtgctggcgacctgccgcgcggtccgcggctgcagcgccgtgacgctgtggggcttcaccgacgcccactcctggcgagccgccgccgaacccctgatcttcgacgcgctctaccggcccaaaccggcgtaccaggctctgctgcgggctctgggaggcaacccttgagccttttcagcccagttttgccaacgaggacagcactatga

SEQ ID NO: 100 - protein, 357 aa, Unknown
  Obtained from an environmental sample
  SIGNAL (1)...(33)
VRSRASAYWFGVGLVVALSLAQTPSPQSLRALAERQGLLVGAAVDLAALYDPLEPEYAQLLAREFNLVVAENAMKWASLSNARGQYSFTGADALVRFARQHGQRLRGHTLIWHEQLPAWVRSGTFSREAMLAVMQEHIQAVAGHFRGQVAYWDVVNEAVSDRGGLRETPFLRAVGPDYLEHAFRFARAADPQAKLFYNDYGADGMGAKSDEIYALLKALKAKGVPVDGVGFQAHLDSTFSVQQARMRENLETLRRPGPRGAHHRAGRAAKRGGLAGGTAGGAGPDLRRGAGDLPRGPRLQRRDAVGLHRRPLLASRRRTPDLRRALPAQTGVPGSAAGSGRQPLSLFSPVLPTRTAL

SEQ ID NO: 101 - DNA, 1131 bp, Unknown
  Obtained from an environmental sample
atgaagtattggcttacaaccctggttttaatgatagcgggaatacccttggcttttggttcttcagcaaagcaagataaatcaaagagtttgaaagatgctttcaaaaacaaattctatatcggtgtggctttgaaccggagtcaatatctggaacaaaacgaacaggcggataaagagataaaggcacagttcagctctattgtagctgagaactgcatgaaaagcgaaaatctggaacctaaagagggaaaattcttctttgacgatgccgatcgttttgtcgcttttggagaaaaaaatggaatgtacatcattggacataccttaatttggcattctcaagtgccaaaatggtttttcatagataatgaaggcaaagttgtttcccgggaagttttgattgaacgaatgaaaaactacatccatacagttgtcggtcattataaaggtcgagttaaaggttgggatgttgtcaatgaggccattctagatgatggctcatttagacaaagtaatttctttaaaatactaggagccgattttattaaacttgcttttcaatttgcccatgaagcagatcccaatgctgagctttattacaacgattattcgatgtccaatccgaccaaaagagacggagtggttcgcatggtgaagtcattgcagcaacaaggtgtgagaatagacgctatcggaatgcagggacacgtagggatggattatcccaagttggatgagtttgaaaatagtatcaaagctttttcgtctttaggaaccaaagtgatgattacggaactcgatttaagtgtcctaccaactcctaaaggaaaacaaggtgctaatatttcggatgttgccgcttatgaggaaaagataaatccttacaaaaatggtctgccggctgaagttgaaaaggcttgggaagaccggtatttggattttttcaaattatttttgaaatatcaacaccaaatttcaagggttacattatgggggcttagtgatcaggattcgtggaaaaatgatttcccagtcagagggagaacggattatcctttgcttttcgacagacaatacaaaccaaaacctgtagttcagaaaattattaaattagcattgaaaaaataa

SEQ ID NO: 102 - protein, 376 aa, Unknown
  Obtained from an environmental sample
  SIGNAL (1)...(23)
MKYWLTTLVLMIAGIPLAFGSSAKQDKSKSLKDAFKNKFYIGVALNRSQYLEQNEQADKEIKAQFSSIVAENCMKSENLEPKEGKFFFDDADRFVAFGEKNGMYIIGHTLIWHSQVPKWFFIDNEGKVVSREVLIERMKNYIHTVVGHYKGRVKGWDVVNEAILDDGSFRQSNFFKILGADFIKLAFQFAHEADPNAELYYNDYSMSNPTKRDGVVRMVKSLQQQGVRIDAIGMQGHVGMDYPKLDEFENSIKAFSSLGTKVMITELDLSVLPTPKGKQGANISDVAAYEEKINPYKNGLPAEVEKAWEDRYLDFFKLFLKYQHQISRVTLWGLSDQDSWKNDFPVRGRTDYPLLFDRQYKPKPVVQKIIKLALKK

SEQ ID NO: 103 - DNA, 1449 bp, Unknown
  misc_feature: Bacterial DNA
  Obtained from an environmental sample
atgcgttcacattcccttcccccgtccaccgtccgccggaaattgggcggcctcggcgcggcgctgctcgtcggcgccgtcggcgccgccaccgtgctcgtggcgcccctcacctcgcacgccgccgagagcacgctcggcgccgcggcgaagcagagcggccggtacttcggcaccgccatcgcctcgggcaggctcaacgactcgacgtacacgacgatcgcgaaccgcgagttcaactcggtgaccgccgagaacgagatgaagatcgacgccaccgaaccccagcagggccgcttcgacttcaccgccggcgaccgcgtctacaactgggcggtgcagaacggcaagcaggtacggggccacaccctggcctggcactcccagcagcccgcctggatgcagaacctcagcggcagcgcgctgcgcacggcgatgaccaaccacatcaacggcgtcatggcccactacaagggcaagatcggccagtgggacgtcgtcaacgaggcgttcgcggacggcagttcgggagcgcgccgggactccaacctccagcggagcggcaacgactggatcgaggtcgccttccgcaccgcccgcgccgccgacccggccgccaagctctgctacaacgactacaacgtcgagaactggacgtgggccaagacccaggccatgtacgccatggtcaaggacttcaagcagcgcggcgtgcccatcgactgcgtcggcttccagtcgcacttcaacaacgacagcccctacaacagcaacttccgcaccaccctccagagtttcgccgccctcggcgtcgacgtggccatcaccgaactcgacatccagggcgcctcgggcacgacctacgccaacgtgaccaacgactgcctggccgtcccgcgctgcctcggcatcaccgtctggggtgtccgcgacaccgactcctggcgagccgagcacactccgctgctcttcaacggcgacggcagcaagaagcccgcctactcctccgtcctcaacgccctcaactccgtctcccccaaccccaaccccactccgaccccctcccccggcgccgggccgatcaagggagtcgcctcgggccgctgcgtggacgtacccggagccggcaccgccgacggcacccaggtccagctgtgggactgcaacaaccgcaccaaccagcagtggaccctcaccgccgccggtgagctcagggtctacggcgacaagtgcctggacgccgccggcaccggcaacggcgccaaggtccagatctacagctgctggggcggcgacaaccagaagtggcgcctcaactccgacggttccatcgtcggtgtccagtccggcctctgcctcgacgccgctgccggcggcaccgccaacggcacgctgatccagctctactcctgctggaacagcggcaaccagcgctggacccgcacctga

SEQ ID NO: 104 - protein, 482 aa, Unknown
  DOMAIN (1)...(482): Bacterial protein
  Obtained from an environmental sample
  SIGNAL (1)...(41)
MRSHSLPPSTVRRKLGGLGAALLVGAVGAATVLVAPLTSHAAESTLGAAAKQSGRYFGTAIASGRLNDSTYTTIANREFNSVTAENEMKIDATEPQQGRFDFTAGDRVYNWAVQNGKQVRGHTLAWHSQQPAWMQNLSGSALRTAMTNHINGVMAHYKGKIGQWDVVNEAFADGSSGARRDSNLQRSGNDWIEVAFRTARAADPAAKLCYNDYNVENWTWAKTQAMYAMVKDFKQRGVPIDCVGFQSHFNNDSPYNSNFRTTLQSFAALGVDVAITELDIQGASGTTYANVTNDCLAVPRCLGITVWGVRDTDSWRAEHTPLLFNGDGSKKPAYSSVLNALNSVSPNPNPTPTPSPGAGPIKGVASGRCVDVPGAGTADGTQVQLWDCNNRTNQQWTLTAAGELRVYGDKCLDAAGTGNGAKVQIYSCWGGDNQKWRLNSDGSIVGVQSGLCLDAAAGGTANGTLIQLYSCWNSGNQRWTRT

SEQ ID NO: 105 - DNA, 2793 bp, Unknown
  Obtained from an environmental sample
atgaagttcactttgatgccgctgctgtgcgggttcgccttgctgttgggttgcgcggtgcaggcaaccccagccgcttcgttacagcaggcttatcagccgtatttccatatcggtactgccgtcagcttggcgcaactgcaagcatcgaaaaaccatgaacgagatttaatcgcccagcactttaacagtctgaccgctgaaaacctgatgaaatgggaaaaaatccaaccgactgaaggcaactttgattttacagcggccgacaagctcgtcgcttttgctgaacaacatcggatgtggctggtcggccatacgatcctgtggcatgaacaaaccccggactgggtatttcaggggccagatggcaaaccggccagcaagcaagtgttactcggcagattaaaaaagcatatccaaactgtggtcggtcgttaccaaggtcgggtacatggctgggatgtagtgaatgaagcgctgaatgaagatggcagtctgcgcgatacgccgtggcgaaaaattctgggtgatgattacattgccaccacttttgcgctggtgcatcaggtcgaccccaaagccaaactctattacaacgactacaacctgtataaaccaaaaaaacgcactggcgtgctacggatcatccagcaactgcagcaacaacaagtgcccattcatgccattggcgaacaagcgcattatggtctcgattcgccgaaattgcaggaagttgaagactcgatcaacgcctttgcagccaccggcctcgacgtgatgctgaccgagttggaaatttcggtgctaccgtttccgcctggcatgacaccaggcgccgatatcagtcagcatcaggaactgcaacaacagctgaatccttaccgcgaaggcttaccaaaaaccgtcgaacaggcctggcaacaacgttatctggatctgttttcgctgttattgcgccagcatcaaaaattacaccgggtgacgttttggggtttagatgatggccaaagctggcgcaataactttccaatgcgcggtcgtaccgattacccgctactgtttgaccgcaagctgcaagccaaaccgctattgagcgcactgatcaaactggcagaaactcaagcctcagccaagccgaaagtaaatcagctcggttttgcgccaaatgcgcaaaaattgctggtggtgccggggcggcaggcggtgtcgtttcagatcatcaatcaaagcaacggcaaaacggtgttgcaaggccaaagttcggtggctcagttttggcccgaatcgggcgagtgggtcagtatcgctgacttttcgaccttaaccacccaagggcgttatcaggttgaagcggctggattaactccgatcaccgtcgagattactgctgaaccttatgccgcgctgcatgatgcgtccatcaaagcctattattttaatcgcgcctcgctggcgctggagccaagttttgccgggccttgggcgcgcgctgccggtcatccggataacaaagtgttggtgcacacttccgccgcttccgacaagcgaccagccggttttgtgatcagcgccgctaaaggctggtatgacgccggtgactataacaaatacgtggtcaattccggtatttccagttacaccctattgcaagcctggcaggattttcctgagttttatcgcgacagaacatggaatcttccggagtccagcaacaacctaccagacattctcgacgagacgttatggaatttacagtggctgagcaccatgcaggacccaagcgacggcggcgtgtatcacaagctgactgaactgaatttctctgctacccaaatgccgtcagaagtgacagcgccacgttatgtggtgcaaaaaaccacggcagcggcacttaatttcgcggcggtgctggccaaagccagtcgcatttttacagaatttgaaacgcaactgcccggcctgtcacagcaatatcgccagcaagcattagcagcctggcaatgggcgcaaaaaaatccacaacaaatttatcagcaaccagccgatgttcacaccggtgcttatggcgacaaacagctggctgatgaatgggcttgggctggggcggagctatatttattaaccggtgagcagagttacctgcagccgttgttggcacttgagacgccaatcaccgcagcttcctgggccaatgtggcggcgttgggttattttgcgttggcatccgctgaacagtttgagcctgcacttcgaaaaaaagtgcagcaaaaaatccaacaagccgcggcgcaaattgtagccgagcatcaagcgtccgcctaccaggtggcgatgactcaaaaagattttgtctggggcagtaatgcggtggcgatgaacaaaggcatgttgttatatcaagcgtggaaaattgacccacaaccagagctgcgacaggcgatgcaagggctgctggattacgtcctcggtcgcaacccgctgcagctgtcttatgtcacaggttttggtgcgcaaagcccgcaacatatccatcaccgcccctcggcggcagatcagatcaaagcaccagtgccgggctggttagtgggtggtgcacagccgggtaagcaagataaatgctcttattccggtatttttgctaccggcactttacccgctgccagcactttacctgcaacgacttatctcgaccactggtgcagctacgccaccaatgaagtggcgattaactggaatgcacctttagtgtacgtgctggcctggagcctttcaccagactccatgaccaaatga

SEQ ID NO: 106 - protein, 930 aa, Unknown
  Obtained from an environmental sample
  SIGNAL (1)...(22)
MKFTLMPLLCGFALLLGCAVQATPAASLQQAYQPYFHIGTAVSLAQLQASKNHERDLIAQHFNSLTAENLMKWEKIQPTEGNFDFTAADKLVAFAEQHRMWLVGHTILWHEQTPDWVFQGPDGKPASKQVLLGRLKKHIQTVVGRYQGRVHGWDVVNEALNEDGSLRDTPWRKILGDDYIATTFALVHQVDPKAKLYYNDYNLYKPKKRTGVLRIIQQLQQQQVPIHAIGEQAHYGLDSPKLQEVEDSINAFAATGLDVMLTELEISVLPFPPGMTPGADISQHQELQQQLNPYREGLPKTVEQAWQQRYLDLFSLLLRQHQKLHRVTFWGLDDGQSWRNNFPMRGRTDYPLLFDRKLQAKPLLSALIKLAETQASAKPKVNQLGFAPNAQKLLVVPGRQAVSFQIINQSNGKTVLQGQSSVAQFWPESGEWVSIADFSTLTTQGRYQVEAAGLTPITVEITAEPYAALHDASIKAYYFNRASLALEPSFAGPWARAAGHPDNKVLVHTSAASDKRPAGFVISAAKGWYDAGDYNKYVVNSGISSYTLLQAWQDFPEFYRDRTWNLPESSNNLPDILDETLWNLQWLSTMQDPSDGGVYHKLTELNFSATQMPSEVTAPRYVVQKTTAAALNFAAVLAKASRIFTEFETQLPGLSQQYRQQALAAWQWAQKNPQQIYQQPADVHTGAYGDKQLADEWAWAGAELYLLTGEQSYLQPLLALETPITAASWANVAALGYFALASAEQFEPALRKKVQQKIQQAAAQIVAEHQASAYQVAMTQKDFVWGSNAVAMNKGMLLYQAWKIDPQPELRQAMQGLLDYVLGRNPLQLSYVTGFGAQSPQHIHHRPSAADQIKAPVPGWLVGGAQPGKQDKCSYSGIFATGTLPAASTLPATTYLDHWCSYATNEVAINWNAPLVYVLAWSLSPDSMTK

SEQ ID NO: 107 - DNA, 1725 bp, Unknown
  misc_feature: Bacterial DNA
gtgtggaagcccggattgtggaatttccttcaaatggcagatgaagccggattgacgagggatggaaacactccggttccgacacccagtccaaagccggctaacacacgtattgaagcggaagattatgacggtattaattcttcaagtattgagataataggtgttccacctgaaggaggcagaggaataggttatattaccagtggtgattatctggtatacaagagtatagactttggaaacggagcaacgtcgtttaaggccaaggttgcaaatgcaaatacttccaatattgaacttagattaaacggtccgaatggtactctcataggcacactctcggtaaaatccacaggagattggaatacatatgaggagcaaacttgcagcattagcaaagtcaccggaataaatgatttgtacttggtattcaaaggccctgtaaacatagactggttcacttttggcgttgaaagcagttccacaggtctgggggatttaaatggtgacggaaatattaactcgtcggaccttcaggcgttaaagaggcatttgctcggtatatcaccgcttacgggagaggctcttttaagagcggatgtaaataggagcggcaaagtggattctactgactattcagtgctgaaaagatatatactccgcattattacagagttccccggacaaggtgatgtacagacacccaatccgtctgttactccgacacaaactcctatccccacgatttcgggaaatgctcttagggattatgcggaggcaaggggaataaaaatcggaacatgtgtcaactatccgttttacaacaattcagatccaacctacaacagcattttgcaaagagaattttcaatggttgtatgtgaaaatgaaatgaagtttgatgctttgcagccgagacaaaacgtttttgatttttcgaaaggagaccagttgcttgcttttgcagaaagaaacggtatgcagatgaggggacatacgttgatttggcacaatcaaaacccgtcatggcttacaaacggtaactggaaccgggattcgctgcttgcggtaatgaaaaatcacattaccactgttatgacccattacaaaggtaaaattgttgagtgggatgtggcaaacgaatgtatggatgattccggcaacggcttaagaagcagcatatggagaaatgtaatcggtcaggactaccttgactatgctttcaggtatgcaagagaagcagatcccgatgcacttcttttctacaatgattataatattgaagacttgggtccaaagtccaatgcggtatttaacatgattaaaagtatgaaggaaagaggtgtgccgattgacggagtaggattccaatgccactttatcaatggaatgagccccgagtaccttgccagcattgatcaaaatattaagagatatgcggaaataggcgttatagtatcctttaccgaaatagatatacgcatacctcagtcggaaaacccggcaactgcattccaggtacaggcaaacaactataaggaacttatgaaaatttgtctggcaaaccccaattgcaatacctttgtaatgtggggattcacagataaatacacatggattccgggaactttcccaggatatggcaatccattgatttatgacagcaattacaatccgaaaccggcatacaatgcaataaaggaagctcttatgggctattga

SEQ ID NO: 108 - protein, 574 aa, Unknown
  DOMAIN (1)...(574): Bacterial protein
VWKPGLWNFLQMADEAGLTRDGNTPVPTPSPKPANTRIEAEDYDGINSSSIEIIGVPPEGGRGIGYITSGDYLVYKSIDFGNGATSFKAKVANANTSNIELRLNGPNGTLIGTLSVKSTGDWNTYEEQTCSISKVTGINDLYLVFKGPVNIDWFTFGVESSSTGLGDLNGDGNINSSDLQALKRHLLGISPLTGEALLRADVNRSGKVDSTDYSVLKRYILRIITEFPGQGDVQTPNPSVTPTQTPIPTISGNALRDYAEARGIKIGTCVNYPFYNNSDPTYNSILQREFSMVVCENEMKFDALQPRQNVFDFSKGDQLLAFAERNGMQMRGHTLIWHNQNPSWLTNGNWNRDSLLAVMKNHITTVMTHYKGKIVEWDVANECMDDSGNGLRSSIWRNVIGQDYLDYAFRYAREADPDALLFYNDYNIEDLGPKSNAVFNMIKSMKERGVPIDGVGFQCHFINGMSPEYLASIDQNIKRYAEIGVIVSFTEIDIRIPQSENPATAFQVQANNYKELMKICLANPNCNTFVMWGFTDKYTWIPGTFPGYGNPLIYDSNYNPKPAYNAIKEALMGY

SEQ ID NO: 109 - DNA, 1242 bp, Unknown
  Obtained from an environmental sample
atgctaaaagttttacgtaaacctattatttctggattagctttagctctattattgccggcaggggcagctggtgccgaaactaatatttcaaagaagccaaatataagtggattaaccgcgccgcaattagaccaaagatataaagattctttcaccattggtgctgcggttgagccgtatcaattattagatgcaaaagattcacaaatgctaaagcggcattttaatagtatcgtagcagagaatgtcatgaagcctagtagtttacagccagtagaaggacaattcaattgggagccggccgataaacttgttcagtttgcgaaggaaaatggaatggacatgcgcggacatacgcttgtctggcatagccaggtaccggattggttctttgaagatgcggcaggaaatccaatggttgtttgggaaaatggcaggcaagtggttgccgatccagcaaatcttcaggaaaacaaagagctcttacttagccgattacaaaatcatattcaggcagtcgtaacgcgttataaagatgatataaaatcttgggatgttgttaatgaagtaatcgatgaatggggcggacattctgaagggctgcgtcaatctccatggttcctcatcaccggaacggactatattaaagttgcttttgaaactgcaagagaatatgcagctccagacgctaagctgtatatcaatgattacaatacagaagtagaaccaaaaaggacgcacctttataacttagtaaaaagtttaaaagaagaacaaaacgttccaattgatggtgttgggcatcagtctcacattcaaattggctggccttcagaaaaagaaattgaagataccattaatatgtttgcagatcttggtttagataaccaaatcaccgagcttgatgttagtatgtatggctggccagtaaggtcgtatccaacttatgatgcgatcccagaacttaaattcatggatcaagcagctcgttatgatcgtttatttaagttatatgagaaattaggagataaaatcagtaatgtgacattctggggtattgcggataaccatacatggctgaatgaccgtgcagatgtttactatgatgaaaatggaaatgttgtattagatagagaaacaccaagagtagaaagaggagcaggaaaagatgcgccatttgtatttgatcctgaatacaatgtaaaaccagcttattgggcaattatcgaccacaaataa

SEQ ID NO: 110 - protein, 413 aa, Unknown
  Obtained from an environmental sample
  SIGNAL (1)...(26)
MLKVLRKPIISGLALALLLPAGAAGAETNISKKPNISGLTAPQLDQRYKDSFTIGAAVEPYQLLDAKDSQMLKRHFNSIVAENVMKPSSLQPVEGQFNWEPADKLVQFAKENGMDMRGHTLVWHSQVPDWFFEDAAGNPMVVWENGRQVVADPANLQENKELLLSRLQNHIQAVVTRYKDDIKSWDVVNEVIDEWGGHSEGLRQSPWFLITGTDYIKVAFETAREYAAPDAKLYINDYNTEVEPKRTHLYNLVKSLKEEQNVPIDGVGHQSHIQIGWPSEKEIEDTINMFADLGLDNQITELDVSMYGWPVRSYPTYDAIPELKFMDQAARYDRLFKLYEKLGDKISNVTFWGIADNHTWLNDRADVYYDENGNVVLDRETPRVERGAGKDAPFVFDPEYNVKPAYWAIIDHK

SEQ ID NO: 111 - DNA, 1089 bp, Unknown
  Obtained from an environmental sample
atgttgacgaccccgacaactcaagatcatgtccccgtgcttaaggacgctttcaaaggcaagttcctcattggagccgtgctgggttatgacgcactccagggaaaggatccggcgagtgtggaaattgcgaccacgcacttcgatgctctcactgcggaaaacagcatgaagcccgctctggtgcaacctaaagagggcgaatttgacttcgctgatggagaccggcttcttgacatcacacagcagtgcggtgcgactgcgattggccacactttgctctggcaccaacagacaccgaaatggtttttcgaggggccagatgaccagcctactaaccgcgagttggccctggcacgcatgagaaagcacatcgccactcttgttggccgttacaaaggtcgcattaagcaatgggatgtggtgaatgaggcgattagcgatgcagagggcgagtacttgagaccaaatagtccatggttcaaggctgttggagaagatcacattgcgcaggctttccgggcagcgcacgaagccgatcctgacgccatcctcatctataacgattacaacatcgagcaggagtacaagcgtcccaaagcgatacgactgctgaggtcattacttgagcaggacgttccccttcatgccgtgggcatccagggccactggcgtatggacactctgaatgttgccgaaatcgaagaagctatcaaagaatttgctgcgctgggtctcaaggtcatgatcaccgagcttgacatcagcgtgctaccgacaaagtatcagggagccgatctctctacccgcgaagaattgacgcctgaaatcaatccctatacggagggactacccgagaacgttgcccggcaacatgccgaatgttaccgccaagtcttcaaaatgttcctgtgccacaaggatgccattggccgtgtcacgctctggggcgttcatgatggcagatcatggttcaatgactttcccgtcagagggcgcaccgattatcctctgcttttcgaccggcagggcaaacccaagccagcattttttgccgtcttgaaggctgcgcaagatcagccacaatga

SEQ ID NO: 112 - protein, 362 aa, Unknown
  Obtained from an environmental sample
MLTTPTTQDHVPVLKDAFKGKFLIGAVLGYDALQGKDPASVEIATTHFDALTAENSMKPALVQPKEGEFDFADGDRLLDITQQCGATAIGHTLLWHQQTPKWFFEGPDDQPTNRELALARMRKHIATLVGRYKGRIKQWDVVNEAISDAEGEYLRPNSPWFKAVGEDHIAQAFRAAHEADPDAILIYNDYNIEQEYKRPKAIRLLRSLLEQDVPLHAVGIQGHWRMDTLNVAEIEEAIKEFAALGLKVMITELDISVLPTKYQGADLSTREELTPEINPYTEGLPENVARQHAECYRQVFKMFLCHKDAIGRVTLWGVHDGRSWFNDFPVRGRTDYPLLFDRQGKPKPAFFAVLKAAQDQPQ

SEQ ID NO: 113 - DNA, 1155 bp, Unknown
  Obtained from an environmental sample
atgttaaaagtattgcgtaaaccacttttttctggattagctttagcgatagtattacctaccggattatccagtgcttatgcagctgaaaatcaaccagttagtgcattagatgcagcggttgaacttgatgaaagatatgcagaatcattcgatattggtgcagccgttgagccttctatgcttcaaggaaaagatgctgaagtattaaagcgtcattataacagcattgtggccgaaaatgtaatgaaaccgattaatatacagcctgaagaaggaaagttcacttttaaagaaatggataaaatcgttaagtttgcgaaagaaaataatatgaagcttcgtggccatacccttatttggcacagtcaagtaccggagtggttcttccttgataaagaaggaaataagatggtggatgaaacggatccaaagcagcgcgaaaaaaataaaaggcttttacttaagcgtttagaaacgcatattaaaacgatcgtcaagcgctataaaaatgatattagctcctgggacgtggtcaacgaggtagtggatgataacgggaaattacgtaattcaccctggtatcaaatcacaggtactgattatatcaaggttgcttttgaaacagcggaccgttatgcagggaagaacgctaagctttatatcaatgactacaacacggaaatagaccctaaaagagaaaccctctataatcttgtcaaggaattagtgaaggagggagtcccagttgatggagtgggacatcaagctcatatccaaatcggctggccaactatagcggaaatcgagaaaaccattaatatgtttgcagaccttggcctagacaatcaaattacagaactagatgttagcctttatgggtggccgccaaagcctgcttacccaacttatgacgaaatcccggcaagtgaattcgaacgtcaagctgttcgttacgatcaactatttgatttatacgagagattgggagataaaattagcagtgtgacattctggggcgttgctgacaaccatacatggttaaatgaccgtgcagaacaatataatgacggggtaggcgtggacgcaccatttgttttcgataaggattataatgtaaaaccagcttattgggctattatcgatcgcgattaa

SEQ ID NO: 114 - protein, 384 aa, Unknown
  Obtained from an environmental sample
  SIGNAL (1)...(28)
MLKVLRKPLFSGLALAIVLPTGLSSAYAAENQPVSALDAAVELDERYAESFDIGAAVEPSMLQGKDAEVLKRHYNSIVAENVMKPINIQPEEGKFTFKEMDKIVKFAKENNMKLRGHTLIWHSQVPEWFFLDKEGNKMVDETDPKQREKNKRLLLKRLETHIKTIVKRYKNDISSWDVVNEVVDDNGKLRNSPWYQITGTDYIKVAFETADRYAGKNAKLYINDYNTEIDPKRETLYNLVKELVKEGVPVDGVGHQAHIQIGWPTIAEIEKTINMFADLGLDNQITELDVSLYGWPPKPAYPTYDEIPASEFERQAVRYDQLFDLYERLGDKISSVTFWGVADNHTWLNDRAEQYNDGVGVDAPFVFDKDYNVKPAYWAIIDRD

SEQ ID NO: 115 - DNA, 1362 bp, Unknown
  Obtained from an environmental sample
atgacgaaccgtaaatcgaacgtgcaccgttcattgaccgatgatttgctcgatggtgtcttcgccgaggcaaaagcgggcaaagttgagaagtaccgtgccaccgggatccttggaacgctattcggattcactgtggcgtcctccatcatgttggcggcttgcagcaacgcacaagagaatgttccaccagttgcttcatccaccgcacagagcaatatcacccaggagaacgttccgccgctcaaagatgcgtttaagggcaagttcttgattggcaccgcggtgagcaatcgcttgctggagggacaagatccggccacggaagccttggtgcgcaggcacttcgatgctctcacggcggaaaacgccatgaagccggatgcactgcaaccgcgcgaaggccagttcaacttcgtcgccgccgaccgtctggtggaaatcgcccagcaaagcggcgcgacagtggtcggccacacgctggtctggcactcccaaacgccaggctggttcttccagggtccgaatggccagccagcgagtcgagaactggccctggcgcggatgcgaacacacatcaagacggtggtgggacgctacaaagggcgcatcaagcagtgggatgtggtcaacgaagcgatcaacgacggccctggcgtgctgcggcaaagtccgtggctgcgtgccatcggcgaagactacatcgccgaagcgttccgcgccgcgcacgaagccgatcctgacgccattctggtctacaacgactacaacatcgaactcaactacaagcgtcccaaggcgctggaactgctaaagaagctcatcgaccagaaggttccgattcatggtgtgggcattcaggctcactggcgcatgaccccgccgctggccgagaccgaagaagccatcaaacagttcgccgcgctgggcctgaaggtgatgttcaccgaactggacatcggtgtgctgcccactcagtatcagggggctgacatctcggcgcgtgaaaccatgacacccgaacagcaagcggtgatgaacccttacactcagggcttgccggctgaagtggcacagcaacatgccgagcgctaccgacaggccttcgagctgttcctgcgccacaaggatgtgattggtcgcgtcacgctctggggcacgcatgatggcgaatcctggctgaacggttttccggtgcggggccgcaccgactatcccttgctcttcgaccgccggtatcagccaaaaccagccttcttcgccgtcaggcaggttgcacaggcgcatactgtacaaacgaccggtgcgcaaacccaagctacagcgaagacaattcaaaaagcttctcgagagtacttctag

SEQ ID NO: 116 - protein, 453 aa, Unknown
  Obtained from an environmental sample
MTNRKSNVHRSLTDDLLDGVFAEAKAGKVEKYRATGILGTLFGFTVASSIMLAACSNAQENVPPVASSTAQSNITQENVPPLKDAFKGKFLIGTAVSNRLLEGQDPATEALVRRHFDALTAENAMKPDALQPREGQFNFVAADRLVEIAQQSGATVVGHTLVWHSQTPGWFFQGPNGQPASRELALARMRTHIKTVVGRYKGRIKQWDVVNEAINDGPGVLRQSPWLRAIGEDYIAEAFRAAHEADPDAILVYNDYNIELNYKRPKALELLKKLIDQKVPIHGVGIQAHWRMTPPLAETEEAIKQFAALGLKVMFTELDIGVLPTQYQGADISARETMTPEQQAVMNPYTQGLPAEVAQQHAERYRQAFELFLRHKDVIGRVTLWGTHDGESWLNGFPVRGRTDYPLLFDRRYQPKPAFFAVRQVAQAHTVQTTGAQTQATAKTIQKASREYF

SEQ ID NO: 117 - DNA, 1437 bp, Unknown
  Obtained from an environmental sample
atgacgaaccgtaaattgaacgtgcaccgttcattgagcgatgatttgctcgatggcgccttcgccgagtcaaaagcgggcaaagttgagaaataccgtgccacggggatccttggaacgctattcggattcactgtggcgtcctccatcatgttggcggcttgcagcaacgcacaagagaatgctccaccagttgcttcatccaccgcacaaagcaatatcacccaggagaacgttccgccgctcaaggatgcgtttaagggcaagttcttgattggcaccatcgcgagcaatcgcttgctgcagggacaagatccagccacagaagccctggtgcgcaggcacttcgacgccctcacggcggaaaatgccatgaagcctgatgccatgcaacccagagagggtgagttcaactttgccgccgctgaccgcctggtggaaatcgcccagcaaagcggcgccacggtggtcggccacaccttggtctggcatagccaaacgccaagctggttcttccagggtccagatggccaaccggcgagtcgggaactggccttggcacggatgcgaacgcacatcaagactgtggtgggacgctacaaaggacgcatcaagcaatgggatgtggtcaacgaagcgatcaacgacggccctggagtgctgcggccatcgccgtggttgcgcgccatcggcgaagacttcatcgccgaagcgttccgcgccgcgcacgaagctgatcccgacgcgattctcgtctacaacgactacaacatcgagctcaactacaagcgtcccaaggcgctggaactactgaagagactcatcgagcagaaggttccgattcatggtgtgggcattcaggctcactggcgcatgaccccgccgctggccgagatggaagagaccatcaagcagttttcggctttgggcttgaaggtaatgatcaccgagttggacattggtgtattgccaacacaataccagggtgccgacatctcggctcgcgagaccatgacacccgaacagcaagcggtgatgaacccttacacgcagggcttgccggctgaagtggcgcagcaacatgccgagcgttatcgtcaggcgtttgagctgttcatgcgttacaaggatgtgattggtcgcgttaccctgtggggcacgcatgatggcgaatcttggctgaacggttttcccgttcgtggccgcacggattatcctctactgttcgaccgccggtatcagcctaagcccgccttcttcgcggtgcaaaaggtcgcgcaggcgcagaacgcacaggcagcaaccgatcaagcaccacttgcacaaaacccagttgcgcagaagaaatctgcaccaaggcaggcggctcaaaatcagaccactcaaaagccagtggtacaaaagcaaagtgcggcaagtcgggccgcagaaaagtaa

SEQ ID NO: 118 - protein, 478 aa, Unknown
  Obtained from an environmental sample
MTNRKLNVHRSLSDDLLDGAFAESKAGKVEKYRATGILGTLFGFTVASSIMLAACSNAQENAPPVASSTAQSNITQENVPPLKDAFKGKFLIGTIASNRLLQGQDPATEALVRRHFDALTAENAMKPDAMQPREGEFNFAAADRLVEIAQQSGATVVGHTLVWHSQTPSWFFQGPDGQPASRELALARMRTHIKTVVGRYKGRIKQWDVVNEAINDGPGVLRPSPWLRAIGEDFIAEAFRAAHEADPDAILVYNDYNIELNYKRPKALELLKRLIEQKVPIHGVGIQAHWRMTPPLAEMEETIKQFSALGLKVMITELDIGVLPTQYQGADISARETMTPEQQAVMNPYTQGLPAEVAQQHAERYRQAFELFMRYKDVIGRVTLWGTHDGESWLNGFPVRGRTDYPLLFDRRYQPKPAFFAVQKVAQAQNAQAATDQAPLAQNPVAQKKSAPRQAAQNQTTQKPVVQKQSAASRAAEK

SEQ ID NO: 119 - DNA, 2559 bp, Unknown
  Obtained from an environmental sample
atgaaaaaaagattgttagcgttgatagtgacattagtttttattatctcattgtttaatcccatattcaccacacctttaacaaatgtagcaaaggctcaaagtaaccaaacaaatttaaaatttgactttgaaaacggtactcaaggttggggagcaagaggtgtttcaacaactattgcaaccgtttacgagcaagcttatgaaggaagttattctttaaaggtttcaggtagaagttcaacgtgggatggagcagttgtggatatcacatcaagtatttcagcaaatgtcacctatacagtttctttatttgttcgtcacagcgatgtaaaaccacaaagattttctgtctatgtatatgtcaaagataacacaggcgaaaaatacatccaggttgcagacaaagtggttatgccaaacttttggaagcagctctttgggaagttcacaatcacaacatcaaatccaattcaaaaagtagaacttcttgtatgtgttccatctaacaaatctttaggattttatcttgacaatgtagttattacttcagcacaaccagcttcctcgggtgttgttaaatcttgcacatttgaaagcggtagcactgagggttttgttcagagaggttcagcttcattgacagttgtcgacggtgtatactatcattctccaacaaaagcattatatgtgacaggaaggacagctacatggcagggtgcacagatagatatgacaagtttgcttgagaagggcaaggattatcagtttagcatatgggtatatcaaaatagtggaagtgatcagaagataacccttacgatgcaaaggaagaatgaagatggaactacgagttatgattctataaagtatcagcaaacagttccatctggtacatggacagaagtaacaggttcatacacagtgcctcagacagcaacacagcttatattctatgttgaatcaccgaatattaattttgacttctaccttgatgactttacagcggttgacaaaaacccacctgttgtaaacccagggcttgttaaatcttgcacatttgaaagcggtagcactgagggttttgttcagagaggttcagcttcattgacagttgtcgacggtgtatactatcattctccaacaaaagcattgtatgtgacaggaaggacagctacatggcagggtgcacagatagatatgacaagtttgcttgagaagggcaaggattatcagtttagcatatgggtatatcaaaatagtggaagtgatcagaagataacccttacgatgcaaaggaagaatgaagatggaactacgagttatgattctataaagtatcagcaaacagttccatctggtacatggacagaagtaacaggttcatacacagtgcctcagacagcaacacagcttatattctatgttgaatcaccgaatattaattttgacttctaccttgatgactttacagtaatagataaaaatccagtgacggtaccgattgcagcaaaagaacccgaatgggaaattccgtcactttgtcagcaatatagtcaatatttctcaataggtgttgcaataccgtataaagtacttcaaaatcctgttgaaagagcaatggtgttaaaacacttcaacagtataacagctgaaaatgagatgaaacctgacgctctgcaaagaacagaagggaactttacattcgatatagcagaccagtatgtaaacttcgcacagcaaaacggtattggaattagagggcatactctggtatggcacagccaagtacctaattggttcttccagcacagtgatggaacttcacttgatccaagcaatccagatgataagcaacttttgagagatagattgaaaaatcatattcaaactgttatgtcaagatacaaagggaaagtctatgcatgggatgttgtaaacgaggcaatagatgaaagccagcctgatggatttagaagaagcgaatggtacagaatacttggtccaacacctgagacaaatggtattccagaatacattgtgcttgctttcaggtatgcaagagaggcggatccggatgcaaaacttttctacaatgactacaacacagagatatctaaaaaaagacagtttatatatgacatggtaaaaaagctacatgatatgggtttaattgatggtgttggtttgcaagggcatataaatgttgattctccaacagtaaaagatatagaagatacaatcaatcttttctcaacaattcctggacttgagatacaggtaacagagcttgacataagcgtttacacaagcagcagtcagcgttatgatacgcttcctcaggatataatgataaaacaagcaatgaagtttaaagaactatttgaaatgttaaagagacatagtgatagagtcacaaatgtgacactttggggacttaaggatgattattcatggctttcaaaggatagaaataactggccattgctttttgacagcaactaccaggcaaaatacagctactgggcaattcaaaaagcttctcgagagtacttctag

SEQ ID NO: 120 - protein, 852 aa, Unknown
  Obtained from an environmental sample
  SIGNAL (1)...(33)
MKKRLLALIVTLVFIISLFNPIFTTPLTNVAKAQSNQTNLKFDFENGTQGWGARGVSTTIATVYEQAYEGSYSLKVSGRSSTWDGAVVDITSSISANVTYTVSLFVRHSDVKPQRFSVYVYVKDNTGEKYIQVADKVVMPNFWKQLFGKFTITTSNPIQKVELLVCVPSNKSLGFYLDNVVITSAQPASSGVVKSCTFESGSTEGFVQRGSASLTVVDGVYYHSPTKALYVTGRTATWQGAQIDMTSLLEKGKDYQFSIWVYQNSGSDQKITLTMQRKNEDGTTSYDSIKYQQTVPSGTWTEVTGSYTVPQTATQLIFYVESPNINFDFYLDDFTAVDKNPPVVNPGLVKSCTFESGSTEGFVQRGSASLTVVDGVYYHSPTKALYVTGRTATWQGAQIDMTSLLEKGKDYQFSIWVYQNSGSDQKITLTMQRKNEDGTTSYDSIKYQQTVPSGTWTEVTGSYTVPQTATQLIFYVESPNINFDFYLDDFTVIDKNPVTVPIAAKEPEWEIPSLCQQYSQYFSIGVAIPYKVLQNPVERAMVLKHFNSITAENEMKPDALQRTEGNFTFDIADQYVNFAQQNGIGIRGHTLVWHSQVPNWFFQHSDGTSLDPSNPDDKQLLRDRLKNHIQTVMSRYKGKVYAWDVVNEAIDESQPDGFRRSEWYRILGPTPETNGIPEYIVLAFRYAREADPDAKLFYNDYNTEISKKRQFIYDMVKKLHDMGLIDGVGLQGHINVDSPTVKDIEDTINLFSTIPGLEIQVTELDISVYTSSSQRYDTLPQDIMIKQAMKFKELFEMLKRHSDRVTNVTLWGLKDDYSWLSKDRNNWPLLFDSNYQAKYSYWAIQKASREYF

SEQ ID NO: 121 - DNA, 1905 bp, Unknown
  Obtained from an environmental sample
atgaagcatatttttattgtattaattgtttccctgctgtttagcttcgggggatatgctcaacaaaccattagcagagctccgcaggggtttgaccagcaacgtgccggcattgcatccggtaaagttgaaatcgtaacctataaatcgaaaaccgtaggagtgaatcgctctgcacgtgtttatacaccagccggattctcaaaaaagaagaaatatcctgtgctttatttattacatggcattggaggcgacgaagatgagtggtacaaaaacggcgttcctcatattattttcgacaacctgattgccgacggcaaaatggaaccgatgattgtggtactgcccaatggtcgcgccatgaaaaacgaccgtgccgaaggaaatattttcgacaaagagaaagttgaagcctttgcaacattcgaaaaagaccttttaaacgatttaataccgtttatcgaaaaaaaataccctgtattaaaaacccgtgagtttcgcgccattgcaggattatcaatgggcggcggacaatcgctcaattttggactgggaaatctcgacaaatttgcatgggtaggcggcttttcatcggcccccaataccaaaatgcccgctgagttggttccaaacactcaaaaggcaacagaaatgcttaagttgctttatgtgtcttgtggcgataaagacaatttaatgcaggttagtcagcgcacccacgattatctgaaagccaataaagtacctcatattttcagggttattcctgatggttaccacgattttaatgtttggaaagacgatttgtatcattacgtacaaatgctgtttaagcctgtggtaatgcccgtagcagcagctactttaaaagatgcttataaagggaaattcttcattggaactgcccttaatacccctcaaattttgggtaccgctgttgatgaagtgaatattgttaaaacccatttcaactccattgttgccgaaaactgtatgaagagtggcccgatgcaaccacaagaagggaaatttgagtttgacctggccgataagtttgtagagtttggagttaaaaacaatatgcagattattggtcatacgcttatctggcattcgcaggcaccccgctggttttttaccgacagcgaaggcaaggacgtatcgcccgaggtgcttaccgagcgcatgaaaaaccatatctatactgttgttggccgttacaaaggcaaggtgcacggatgggatgtggtgaatgaagccatagttgacgatggcagctaccgaaacagtaaattctaccaaatactgggcgaagattttatcaaactggcattccagtttgctcatgaagccgaccccgatgcagaattgtactacaacgattattccgaatttgttcctgccaaaagagaaggcattgcccgcatggtgaagaaactcaaagaccagggcattagaatcgacggcgttggatttcagtgccatattggcctcgattatccaggcctggatgaatacgaaaaaaccattcaattaattgccaacgagggggtaaaagtaatgataaccgaaatggaaatatcggtattacccatgcccgactggcgcgttggtgctgagatttcggccagtttcgaatatcaacagaaattaaatccctacaccgaaggattgcccgattcagtgaatgctcaattagaacagcgttatgtcgactttttcacgctcttccttaaatatcacgaagtgattccaagagttacggtttggggggttaacgatggcaactcatggaaaaacggattcccggtgcgtggaagaaccgactacccattgttattcgaccggaaaaatcagcctaaatcagctgttgccaaattaattgaactggctaatacaaagtag

SEQ ID NO: 122 - protein, 634 aa, Unknown
  Obtained from an environmental sample
  SIGNAL (1)...(20)
MKHIFIVLIVSLLFSFGGYAQQTISRAPQGFDQQRAGIASGKVEIVTYKSKTVGVNRSARVYTPAGFSKKKKYPVLYLLHGIGGDEDEWYKNGVPHIIFDNLIADGKMEPMIVVLPNGRAMKNDRAEGNIFDKEKVEAFATFEKDLLNDLIPFIEKKYPVLKTREFRAIAGLSMGGGQSLNFGLGNLDKFAWVGGFSSAPNTKMPAELVPNTQKATEMLKLLYVSCGDKDNLMQVSQRTHDYLKANKVPHIFRVIPDGYHDFNVWKDDLYHYVQMLFKPVVMPVAAATLKDAYKGKFFIGTALNTPQILGTAVDEVNIVKTHFNSIVAENCMKSGPMQPQEGKFEFDLADKFVEFGVKNNMQIIGHTLIWHSQAPRWFFTDSEGKDVSPEVLTERMKNHIYTVVGRYKGKVHGWDVVNEAIVDDGSYRNSKFYQILGEDFIKLAFQFAHEADPDAELYYNDYSEFVPAKREGIARMVKKLKDQGIRIDGVGFQCHIGLDYPGLDEYEKTIQLIANEGVKVMITEMEISVLPMPDWRVGAEISASFEYQQKLNPYTEGLPDSVNAQLEQRYVDFFTLFLKYHEVIPRVTVWGVNDGNSWKNGFPVRGRTDYPLLFDRKNQPKSAVAKLIELANTK

SEQ ID NO: 123 - DNA, 1200 bp, Unknown
  Obtained from an environmental sample
atgatcgttggattctcgtttatgctgctgcttcctttagggatgacgaatgcattggcaaaaacggaaccagcgtacgctaaaaagccgcgaatcagcgcattgcacgcccctcaattggatcagcgctacaaagattccttcactattggggcggccgttgaaccttatcagttgcaaaacgaaaaagacgtccaaatgctgaaacgccattttaacagcattgtcgctgagaacgttatgaaaccgatcaacatccaacccgaagaaggaaagttcaattttgctgaggcggatcaaatcgtccgatttgctaaaaaacatcatatggatattcgtttccatacactcgtttggcacagccaagtacctcaatggttctttcttgacaaggaaggcaagccgatggtcaatgaaacggatccggcaaagcgcgaacaaaataaacagctgttactgaaacggctcgaaatccatattaaaacgattgtcgaacggtataaagacgacatcaaatattgggacgtcgtgaacgaggtagtcggggatgatggaaaattgcgcaattccccgtggtatcaaatcgccggcatcgattatatcaaggtagcattccaaacggcgagaacatatggcggcaacaagattaaactgtacatcaacgattacaataccgaagtggaaccgaagcgaagcgctctttataacttagtgaaacaattaaaagaagaaggcgttcccattgacgggattggccaccagtcccacatccaaattggctggccttctgaagaagaaatcgaaaaaacgatcaacatgtttgccgatctagggttagacaatcaaattacggagctggatgtgagcatgtacggctggccgccgcgcgcctacccgtcgtatgacgccattccggaacaaaagtttttggaccaagcggctcgctatgaccgattgtttaagctgtacgaaaaacttggcgataaaatcagcaacgtcaccttctggggcatcgccgacaaccatacgtggctcgacagccgtgcggatgtgtactatgacgccaacgggaatgttgtggttgacccgaacgctccgtacgcaaaagtggaaaaagggaaaggaaaagatgcgccgtttctgttcgaccccgaataccacgtaaaacctgcgtattgggccattatcgatcataagtga

SEQ ID NO: 124 - protein, 399 aa, Unknown
  Obtained from an environmental sample
  SIGNAL (1)...(20)
MIVGFSFMLLLPLGMTNALAKTEPAYAKKPRISALHAPQLDQRYKDSFTIGAAVEPYQLQNEKDVQMLKRHFNSIVAENVMKPINIQPEEGKFNFAEADQIVRFAKKHHMDIRFHTLVWHSQVPQWFFLDKEGKPMVNETDPAKREQNKQLLLKRLEIHIKTIVERYKDDIKYWDVVNEVVGDDGKLRNSPWYQIAGIDYIKVAFQTARTYGGNKIKLYINDYNTEVEPKRSALYNLVKQLKEEGVPIDGIGHQSHIQIGWPSEEEIEKTINMFADLGLDNQITELDVSMYGWPPRAYPSYDAIPEQKFLDQAARYDRLFKLYEKLGDKISNVTFWGIADNHTWLDSRADVYYDANGNVVVDPNAPYAKVEKGKGKDAPFLFDPEYHVKPAYWAIIDHK

SEQ ID NO: 125 - DNA, 1089 bp, Unknown
  Obtained from an environmental sample
atgttgacgaccccgacaactcaagatcatgtccccgtgctcaaggacgctttcaaaggcaagctcctcattggagccgtgctcggttacgatgctctccaggggaaggacccgctgagtgagaaaattgcgaccactcacttcgatgctctcactgctgaaaacagcatgaagccggctctcgtgcaacccaaagagggcgagtttgatttcgctgatggagatcgtctccttgaaatcgcgcagcaatgcggcgctactgcaatcggccatactctgctctggcaccaacaaacgccacgctggttttttgaagggccagatggtcagcctgctgaccgtgagttggccctggcacgcatgaggaagcacatttccactctcgttggtcgctataaaggtcgcattaaacaatgggatgtggtgaatgaggcgattagcgatgcagagggcgagtacttaagaccaaagagcccctggttcaaagccgttggagaggatcacatcgcgcatgctttccaggcagcacatgaagctgatcccgatgccatccttatctataacgactacaacatcgagcaggagtacaagcgcccgaaggcgatacgcctactgaggtcattacttgagcaggacgttcccattcatgccgtgggcattcagggccattggcgtatggacactctgaatgttgccgaaatcgaagaagctatcgaagaatttgctgcgctgggtctcaaggtcatgatcaccgagcttgatatcagcgtgctaccgacaaagtatcagggagccgatctcgctactcgggaagaattgacgcctgaaatcaatccctatacggaggaactacctgaggacgttgcccggcaacatgccgagtgttatcggcaggtcttcgaaatgttcctgcgccacaaggatgccattagccgtgtcacgctctggggcattcacgatggcagatcatggttcaacaactttccggtcagggggcgcacagactatcctctgctattcgaccgggaatgtaaccccaagccagcgtttttcgccgtcttgaaagctgcgcaagaccagccacaatga

SEQ ID NO: 126 - protein, 362 aa, Unknown
  Obtained from an environmental sample
MLTTPTTQDHVPVLKDAFKGKLLIGAVLGYDALQGKDPLSEKIATTHFDALTAENSMKPALVQPKEGEFDFADGDRLLEIAQQCGATAIGHTLLWHQQTPRWFFEGPDGQPADRELALARMRKHISTLVGRYKGRIKQWDVVNEAISDAEGEYLRPKSPWFKAVGEDHIAHAFQAAHEADPDAILIYNDYNIEQEYKRPKAIRLLRSLLEQDVPIHAVGIQGHWRMDTLNVAEIEEAIEEFAALGLKVMITELDISVLPTKYQGADLATREELTPEINPYTEELPEDVARQHAECYRQVFEMFLRHKDAISRVTLWGIHDGRSWFNNFPVRGRTDYPLLFDRECNPKPAFFAVLKAAQDQPQ

SEQ ID NO: 127 - DNA, 960 bp, Unknown
  Obtained from an environmental sample
gtggatctcgctgagaaatgcggcatatatattggtgcagcggttgaacccggatatttaattatcagggaatacgctgagattttatcccgcgaatttaacgtggtaaccgcggaaaatgcattaaaatttgaagctattcatccgcagcgtggagtatattcatttgaaggtgcagatgcaatagttcgatttgcagaaactcatggaatgaaggttcgtggacatacacttgtttggcaccagcagcttcctgcatggataacttctggaagttacgcttgggaggagtggaagaatattctccgtgagcatgtaatgagcgttgttggacgatataagggccaaatatatgcatgggatgtggttaacgaagcaatattagataacggttcattaagagataatgtttggtttagaaatgtaggtccagaatatattgagtcagcctttagatgggctcatgaagctgacccaaacgctcttctcttctataatgattatgaagctgaggacttgaatgataagtcgcatgctgtttataacctggttaagagtttacttgagaaaggtgtaccgatacatggcgtaggattacagatgcatattaacgtagaaaatccgccgaaaccggaagatgttgcagcaaacattaaacgtctaaatgatctgggcttgattgtccacataacggaaatggatgtgcgcattagaaccccaccatcaaatgaagatctcattaaacaagcagaaatttaccgtgatatattaagagtttgtctttcatcagaaaaatgcacagcattcattatgtggggatttactgaccgctattcatggataccaaattacttcagcggctacggttcagctttaatattcgatgagcaatataagcccaaactagcatattactatatacttcggacattcatcgaaaaactaggcattaaaggttaa

SEQ ID NO: 128 - protein, 319 aa, Unknown
  Obtained from an environmental sample
VDLAEKCGIYIGAAVEPGYLIIREYAEILSREFNVVTAENALKFEAIHPQRGVYSFEGADAIVRFAETHGMKVRGHTLVWHQQLPAWITSGSYAWEEWKNILREHVMSVVGRYKGQIYAWDVVNEAILDNGSLRDNVWFRNVGPEYIESAFRWAHEADPNALLFYNDYEAEDLNDKSHAVYNLVKSLLEKGVPIHGVGLQMHINVENPPKPEDVAANIKRLNDLGLIVHITEMDVRIRTPPSNEDLIKQAEIYRDILRVCLSSEKCTAFIMWGFTDRYSWIPNYFSGYGSALIFDEQYKPKLAYYYILRTFIEKLGIKG

SEQ ID NO: 129 - DNA, 3021 bp, Unknown
  misc_feature: Bacterial DNA
atggtaataaatcgctccagtgcgagtgacggtgcgtattcggaaaaaggtttctatctcgacggtggtgtagaatacaagtacagtgtttttgtaaaacacaacgggaccggcaccgaaactttcaaactttctgtgtcctatttggattcggaaacagaagaagaaaataaggaagtaattgcaacaaaggatgttgtggccggagaatggactgagatttcggcaaaatacaaagcacccaaaactgcagtgaatattactttgtcaattacaaccgacagcactgtagatttcatttttgacgatgtaaccataacccgtaaaggaatggctgaggcaaacacagtatatgcagcaaacgctgtgctgaaagatatgtatgcaaactatttcagagttggttcggtacttaactccggaacggtaaacaattcatcaataaaggccttgattttaagagagtttaacagtattacctgtgaaaatgaaatgaagcctgatgccacactggttcaatcaggatcaaccaatacaaatatcagggtttctcttaatcgtgcagcaagtattttaaacttctgtgcacaaaataatatagccgtcagaggtcatacactggtttggcacagccagacacctcaatggtttttcaaagacaatttccaggacaacggaaactgggtttcccaatcagttatggaccagcgtttggaaagctacataaaaaatatgtttgctgaaatccaaagacagtatccgtctttgaatctttatgcctatgacgttgtaaatgaggcagtaagtgatgatgcaaacaggaccagatattatggcggggcgagggaacctggatacggaaatggtagatctccatgggttcagatctacggagacaacaaatttattgagaaagcatttacatatgcaagaaaatatgctccggcaaattgtaagctttactacaacgattacaacgaatattgggatcataagagagactgtattgcctcaatttgtgcaaacttgtacaacaagggcttgcttgacggtgtgggaatgcagtcccatattaatgcggatatgaatggattctcaggtatacaaaattataaagcagctttgcagaaatatataaatatcggttgtgatgtccaaattaccgagcttgatattagtacagaaaacggcaaatttagcttacagcagcaggctgataaatataaagctgttttccaggcagctgttgatataaacagaacctccagcaaaggaaaggttacggctgtctgtgtatggggacctaatgacgccaatacttggctcggttcacaaaatgcacctcttttgtttaacgcaaacaatcaaccgaaaccggcatacaatgcggttgcatccattattcctcagtccgaatggggcgacggtaacaatccggccggcggcggaggaggaggcaaaccggaagagccggatgcaaacggatattattatcatgacacttttgaaggaagcgtaggacagtggacagccagaggacctgcggaagttctgcttagcggaagaacggcttacaaaggttcagaatcactcttggtaaggaaccgtacggcagcatggaacggagcacaacgggcgctgaatcccagaacgtttgttcccggaaacacatattgtttcagcgtagtggcatcgtttattgaaggtgcgtcttccacaacattctgcatgaagctgcaatacgtagacggaagcggcactcaacggtatgataccatagatatgaaaactgtgggtccaaatcagtgggttcacctgtacaatccgcaatacagaattccttccgatgcaacagatatgtatgtttatgtggaaacagcggatgacaccattaacttctacatagatgaggcaatcggagcggttgccggaactgtaatcgaaggacctgctccacagcctacacagcctccggtactgcttggcgatgtaaacggtgatggaaccattaactcaactgacttgacaatgttaaagagaagcgtgttgagggcaatcacccttaccgacgatgcaaaggctagagcagacgttgacaagaatggatcgataaacagcactgatgttttacttctttcacgctaccttttaagagtaatcgacaaatttcctgtagcagaaaatccttcttcttcttttaaatatgagtcggccgtgcaatatcggccggctcctgattcttatttaaacccttgtccgcaggcgggaagaattgtcaaggaaacatatacaggaataaacggaactaagagtcttaatgtatatcttccatacggttatgatccgaacaaaaaatataacattttctaccttatgcatggcggcggtgaaaatgagaatacgattttcagcaacgatgttaaattgcaaaatatccttgaccacgcgattatgaacggtgaacttgagcctttgattgtagtaacacccactttcaacggcggaaactgcacggcccaaaacttttatcaggaattcaggcaaaatgtcattccttttgtggaaagcaagtactctacttatgcagaatcaacaaccccacagggaatagccgcttcaagaatgcacagaggtttcggcggattctcaatgggaggattgacaacatggtatgtaatggttaactgccttgattacgttgcatattttatgcctttaagcggtgactactggtatggaaacagtccgcaggataaggctaattcaattgctgaagcaattaacagatccggactttcaaagagggagtatttcgtatttgcggccaccggttccgaggatattgcatatgctaatatgaatcctcaaattgaagctatgaaggctttgccgcattttgattatacttcggatttttccaaaggtaatttttactttcttgtagctccgggcgccactcactggtggggatacgtaagacattatatttatgatgcacttccatatttcttccatgaatga

SEQ ID NO: 130 - protein, 1006 aa, Unknown
  DOMAIN (1)...(1006): Bacterial protein
MVINRSSASDGAYSEKGFYLDGGVEYKYSVFVKHNGTGTETFKLSVSYLDSETEEENKEVIATKDVVAGEWTEISAKYKAPKTAVNITLSITTDSTVDFIFDDVTITRKGMAEANTVYAANAVLKDMYANYFRVGSVLNSGTVNNSSIKALILREFNSITCENEMKPDATLVQSGSTNTNIRVSLNRAASILNFCAQNNIAVRGHTLVWHSQTPQWFFKDNFQDNGNWVSQSVMDQRLESYIKNMFAEIQRQYPSLNLYAYDVVNEAVSDDANRTRYYGGAREPGYGNGRSPWVQIYGDNKFIEKAFTYARKYAPANCKLYYNDYNEYWDHKRDCIASICANLYNKGLLDGVGMQSHINADMNGFSGIQNYKAALQKYINIGCDVQITELDISTENGKFSLQQQADKYKAVFQAAVDINRTSSKGKVTAVCVWGPNDANTWLGSQNAPLLFNANNQPKPAYNAVASIIPQSEWGDGNNPAGGGGGGKPEEPDANGYYYHDTFEGSVGQWTARGPAEVLLSGRTAYKGSESLLVRNRTAAWNGAQRALNPRTFVPGNTYCFSVVASFIEGASSTTFCMKLQYVDGSGTQRYDTIDMKTVGPNQWVHLYNPQYRIPSDATDMYVYVETADDTINFYIDEAIGAVAGTVIEGPAPQPTQPPVLLGDVNGDGTINSTDLTMLKRSVLRAITLTDDAKARADVDKNGSINSTDVLLLSRYLLRVIDKFPVAENPSSSFKYESAVQYRPAPDSYLNPCPQAGRIVKETYTGINGTKSLNVYLPYGYDPNKKYNIFYLMHGGGENENTIFSNDVKLQNILDHAIMNGELEPLIVVTPTFNGGNCTAQNFYQEFRQNVIPFVESKYSTYAESTTPQGIAASRMHRGFGGFSMGGLTTWYVMVNCLDYVAYFMPLSGDYWYGNSPQDKANSIAEAINRSGLSKREYFVFAATGSEDIAYANMNPQIEAMKALPHFDYTSDFSKGNFYFLVAPGATHWWGYVRHYIYDALPYFFHE

SEQ ID NO: 131 - DNA, 1218 bp, Unknown
  Obtained from an environmental sample
atgccgatcatccgaaccctatcgagttacatgcgaaatcatcaagcgatctaccgtcagctcctcacgctggccgccgccgtcacgctggcgggcgcggccaccgcggaggaagaagccaccctgcgcggggtttacgaaaaggacttcaccatcggcgtggccatgaacgggggccaggcctccggccgcaatgccgccgccggcgagatcatcggcaagcagttctcctcgctcaccgcggagaacgacatgaagtggcagatgatccacccccaggagggtcaataccgcttcgaaacgtccgacgcctacgtcgcgttcgcggaaaagcacaagatggaagtcatcggccacaccctcgtgtggcacagccagaccccgcagtgggtcttccagggtgaaaacggccagcccgccaccaaggaagagctgctcaagcgcatgcgcgaccacatccacgccgtggccggccgttacaagggcaagatcaagggctgggacgtcgtcaacgaagcgctctccgacggcggggacgacattctccgccagtccccctggcgccgcatcatcggcgacgacttcatcgactacgccttccgctacgccaaggaagccgccccggatgccgagctctactacaacgactacaacctcgagatcccccgcaagcgcgccaattgcatcacgctggtcaagggcatgctcgagcgcggcgtgccgatcgacggcatcggcacccagtcgcacttccagctcggctttccctccttggacgacgtggaagccaccatcaaggaattcgccgccctgggcatgaaggtgatgatcaccgagctcgacgtggatgtcctgccccgcaacaaccccggggtcgccgacatcgccaaccgcgaacagggagccaacccctacaccgaaggccttccggacgacgtgcaggaaaagctcgcgaagcgctacgaggacatcttccgcatctacctgaagtaccgcgaccacgtcacccgcgtcaccttctggggcctggatgacggcatgacctggctgaacggcttcccggtccgcggccgcaccaaccaccccctgctctacgaccggcagctcaatgccaagcccgccttccacgccctcgtcaagctgggtcaggaagagcgtccggaagccgccaaggtcgaggtccagaagatcgaagcgaagaaagaagaggcgaagtaa

SEQ ID NO: 132 - protein, 405 aa, Unknown
  Obtained from an environmental sample
  SIGNAL (1)...(26)
MPIIRTLSSYMRNHQAIYRQLLTLAAAVTLAGAATAEEEATLRGVYEKDFTIGVAMNGGQASGRNAAAGEIIGKQFSSLTAENDMKWQMIHPQEGQYRFETSDAYVAFAEKHKMEVIGHTLVWHSQTPQWVFQGENGQPATKEELLKRMRDHIHAVAGRYKGKIKGWDVVNEALSDGGDDILRQSPWRRIIGDDFIDYAFRYAKEAAPDAELYYNDYNLEIPRKRANCITLVKGMLERGVPIDGIGTQSHFQLGFPSLDDVEATIKEFAALGMKVMITELDVDVLPRNNPGVADIANREQGANPYTEGLPDDVQEKLAKRYEDIFRIYLKYRDHVTRVTFWGLDDGMTWLNGFPVRGRTNHPLLYDRQLNAKPAFHALVKLGQEERPEAAKVEVQKIEAKKEEAK

SEQ ID NO: 133 - DNA, 1011 bp, Unknown
  Obtained from an environmental sample
atgaaaaataatcaatttaggaaaatcccttccctacataaggtatataagagtcattttttaattggggcagctgtaaatccacttacacttcaaacacaacaggaactaatcaaaaagcactttaatagtattacggcagaaaatgaaatgaaatttgaagagttgcaacctgagcctggacattttacatttgatgtaggagataaaatggtcgctttcgcaaaagaaaatggtatgaaagttagaggtcatacattaatctggcacaatcaaacacctgattggatgtttaagaatgaagatggttctgtcacagatcgagatacacttcttgaaagaatgaaattacatattacaactgttatggagcattataaggggcaaatttattgttgggatgttgtcaatgaagcgattgctgatgaaggatcagagttattacgtcactctaaatggactgaaattattggcgacgattttattgaaaaggcatttgagtatgcacatgaagcagacccagaagctttactattctataatgactataatgagtcccaccctcataagcgagataaaatttacacactaataaaaagattggtagacaaaggcatacctattcacggggttggcttgcaagcacattggaatttaacagacccttcttatgaggagattagggctgcaattgaaaaatatgcctcattaggcttggaaatacatcttacagaaatggatgtttcagtgttcaattttgaagatcgaagaacagacttaacagagccgactaatgaaatgaagactcttcaagtagaacgttatacggaatttttcaaaatacttagagaatatagccatgtgattagctctgtcactttttggggagctgcagatgattatacttggttggatgggtttccagttagaggaaggaaaaactggccatttgtttttgacgaaaaccaccaaccgaaagaatctttctggggaattgtcgattttgaataa

SEQ ID NO: 134 - protein, 336 aa, Unknown
  Obtained from an environmental sample
MKNNQFRKIPSLHKVYKSHFLIGAAVNPLTLQTQQELIKKHFNSITAENEMKFEELQPEPGHFTFDVGDKMVAFAKENGMKVRGHTLIWHNQTPDWMFKNEDGSVTDRDTLLERMKLHITTVMEHYKGQIYCWDVVNEAIADEGSELLRHSKWTEIIGDDFIEKAFEYAHEADPEALLFYNDYNESHPHKRDKIYTLIKRLVDKGIPIHGVGLQAHWNLTDPSYEEIRAAIEKYASLGLEIHLTEMDVSVFNFEDRRTDLTEPTNEMKTLQVERYTEFFKILREYSHVISSVTFWGAADDYTWLDGFPVRGRKNWPFVFDENHQPKESFWGIVDFE

SEQ ID NO: 135 - DNA, 1170 bp, Unknown
  Obtained from an environmental sample
atgcgacgcctcatcgcccttgtcctatatataggaaccgccgcgagcgggacctccgtggagaccgttgcggccgaatcgaaacagccgaaagctagcctaaagaatgcgttcgcagacgattttcgtgtcggcgctgcaattggcaccaatcaggtcatgggcgaggagccaaaatcgctcgaggttgtcgcccagcagttcaacacaatcacgcctgagaatctcctcaaatgggctgaggtccacccagaagcagaccgctacaacttcgaaccgtccgatcgcttcgtcgaatttggcgaaaagaacaacatgttcatcgtcggccacacgctcgtgtggcataaccaaacgccggactgggcctttgagggcaaggacggcaagccgctcgatcgcgaaacagcgctcgcccgaatcaaggaacacattgaaaccgtggtcggccgatatcgcggccgcatccatgcttgggacgtcgtgaacgaggcaatcgacgacaacggcaaacttcgtagtgggccggtcggagtgcccggtcagcgcggcgaaccgtggcacgccgccatcggagacgactacatccagaaggcgttcgaattcgcgcacaccgccgaccccgacgctgaactctattacaacgactacaacgaatggcacccgaaaaagatcgaagccatctcgcagctggtgcggtcgctcaaagagaagggcgttcgtatcgatggcctcggtctccagggccattgggggatggattacccgaaagtcgaagagatcgatcacatgctaaccgagtatggcaagctcggcgtgaagctcatgattaccgaactcgacatcaacatgcttccgcagcccgacccgagtcaacgcggcgccgatatcactcgcaactacgagctcagaaaggagctcgatccgtattccgacggactcccgcccgatatgcaaaaggcactcgcggcgcgttatgctgaaatcttcgaagtcttcgctaagcatcgcgataagctcgaccgcgtcacattttggggcgttcacgacggccattcatggctcaacaactggcctgttcccggtcgcactgcctacccgcttctcttcgacacgaagcttcagcccaagccggcatttgatgccgtcatcggagtcgcagagcaatga

SEQ ID NO: 136 - protein, 389 aa, Unknown
  Obtained from an environmental sample
  SIGNAL (1)...(25)
MRRLIALVLYIGTAASGTSVETVAAESKQPKASLKNAFADDFRVGAAIGTNQVMGEEPKSLEVVAQQFNTITPENLLKWAEVHPEADRYNFEPSDRFVEFGEKNNMFIVGHTLVWHNQTPDWAFEGKDGKPLDRETALARIKEHIETVVGRYRGRIHAWDVVNEAIDDNGKLRSGPVGVPGQRGEPWHAAIGDDYIQKAFEFAHTADPDAELYYNDYNEWHPKKIEAISQLVRSLKEKGVRIDGLGLQGHWGMDYPKVEEIDHMLTEYGKLGVKLMITELDINMLPQPDPSQRGADITRNYELRKELDPYSDGLPPDMQKALAARYAEIFEVFAKHRDKLDRVTFWGVHDGHSWLNNWPVPGRTAYPLLFDTKLQPKPAFDAVIGVAEQ

SEQ ID NO: 137 - DNA, 1044 bp, Unknown
  Obtained from an environmental sample
gtggatccttcgctgaaggaagcagcttcgggcaagtttctgatgggggtagcgttgaatgtacgtcaggcagcaggtcaggatacttgcgcctcgaaagtggtaaaacgtcattttaattccattgtggccgagaattgcatgaaatgcgaagtgattcatccggaggaagaccattttgattttacggaagcggaccggttggttcgttttggcgaggagaacgatatggctgttatcgggcattgccttatctggcattcacagctggcaccttggttctgtgtggacaaacaaggaaaaacagtaagtgccgacatcttgaaggagcgtataaaaaaacatatccagactattgtgacgcactataaagggcgtataaagggctgggatgtgttgaatgaagccattgaatcggacggctcctggcgtaaatctcctttttacgagatattaggcgaagagtacatcccgcttatttttcagtatgctcatgaggcagatccggaagccgaactttactataatgattatggcatggacgggaaggctaagcgtgacaaagtagtcgaattggtaaagatgctgaaagatcgtggactgcgcatcgacgcggtaggtatgcagggacacatgggaatggattatccgtcagtgtccgaatttgaagccagtatactggcatttgcagctgccggagtaaaggtgatggtaaccgaatgggatatgagtgcattgcccacgacacggatgggagccaatatttcggacacggtgtcttataaacaatccctgaatccctatcccgacggtttgcccgactctgtgtctgtggcatggaataaccggatgaaggaatttttcggtcttttcctgaaacattcgaatatcattacccgtgtgacggcgtggggggtgacggacggtgactcatggaagaataatttccctgtgcccggacgtgtggattatcctttattgttcgaccgtgattgccggccgaaaccttttgtggaagaactgattggaaaacagaacatttaa

SEQ ID NO: 138 - protein, 347 aa, Unknown
  Obtained from an environmental sample
VDPSLKEAASGKFLMGVALNVRQAAGQDTCASKVVKRHFNSIVAENCMKCEVIHPEEDHFDFTEADRLVRFGEENDMAVIGHCLIWHSQLAPWFCVDKQGKTVSADILKERIKKHIQTIVTHYKGRIKGWDVLNEAIESDGSWRKSPFYEILGEEYIPLIFQYAHEADPEAELYYNDYGMDGKAKRDKVVELVKMLKDRGLRIDAVGMQGHMGMDYPSVSEFEASILAFAAAGVKVMVTEWDMSALPTTRMGANISDTVSYKQSLNPYPDGLPDSVSVAWNNRMKEFFGLFLKHSNIITRVTAWGVTDGDSWKNNFPVPGRVDYPLLFDRDCRPKPFVEELIGKQNI

SEQ ID NO: 139 - DNA, 1143 bp, Unknown
  Obtained from an environmental sample
atgaaaaaaacgattgcacatttcaccttatggatagtgttttttctcttcacttcctgtactgttacggcgcagaagaatgctaagaatgcaagagtaaaacccactaccctaaaagaggcttaccaaggtaaattctatatcggtactgcgatgaacttgagacagattcacggagatgatccccaatctgaaaatattatcaaaaaacagttcaattccatagttgccgaaaactgcatgaagagtatgtatcttcagccggaggaaggaaaatttttcttcgatgatgcggacaagtttgtggattttggtcttcagaacaatatgttcattatcgggcattgtctgatttggcattcgcaggcgccaaaatggtttttcaccgacgaaaatggaaacacggtttctccagaagttcttaaacaaaggatgaaagcccatatcaccgctgtcgtttcccgctacaaagggaaaatcaaaggttgggatgtggtgaacgaagccattatggaagatggttcttaccgcaaaagcaaattttacgagattttgggagaagaatttattccgttggcatttcagtatgcgcatgaagcagatcctgatgcagaactttattacaacgattataacgaatggtatcccgggaaaagagctatggtgaccaaaataatccgcgatttcaaaactagaggaatccgcatcgatgccatcggaatgcaggctcatttcgggatggattcgcccactgtagaagagtatgaacaaactattcagggctatataaaagaaggcgtgaaagtcaatattacggaactcgatttaagtccgcttccttctccttggggaacttccgccaacgttgctgatacgcagcagtatcaggaaaaaatgaatccttacaccaaaggacttcctgtcgatgtagaaaaagcatgggaaaaccgttatctcgattttttcaaacttttcctaaaatatcatcagcatattgagcgtgtaactttttggggagtgagcgacatcgattcctggaaaaacgattttccgataagaggacgtaccgattatccactaccgtttaaccgtcaatatcaggcaaaacctttggttcagaaattaatagacttaacgaaatag

SEQ ID NO: 140 - protein, 380 aa, Unknown
  Obtained from an environmental sample
  SIGNAL (1)...(24)
MKKTIAHFTLWIVFFLFTSCTVTAQKNAKNARVKPTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGNTVSPEVLKQRMKAHITAVVSRYKGKIKGWDVVNEAIMEDGSYRKSKFYEILGEEFIPLAFQYAHEADPDAELYYNDYNEWYPGKRAMVTKIIRDFKTRGIRIDAIGMQAHFGMDSPTVEEYEQTIQGYIKEGVKVNITELDLSPLPSPWGTSANVADTQQYQEKMNPYTKGLPVDVEKAWENRYLDFFKLFLKYHQHIERVTFWGVSDIDSWKNDFPIRGRTDYPLPFNRQYQAKPLVQKLIDLTK

SEQ ID NO: 141 - DNA, 1134 bp, Unknown
  Obtained from an environmental sample
atgaatatctcacgcagacaactactggcgctcacgggtgctacggcggcgatcacagcagccaaattacaggcggcagaaaaagccagcgccgcgaccggcttgcgcgatgcctacaaaaatgattttttgattggcgctgcgctgagtgcatcgatcattcaacagcaagatccacagctagttgcactgattaataaagactttaattccatcaccccagaaaactgtatgaaatggggcgagatgcgcaatgatgacggcagctggaagtggcaggatgcagacgcatttgtcgagtatggaagcaaatacaaactacatatggtcggccacacattggggtggcacagccagattcccgatagcgtgtttaaaaataaagacggtagctatatttccaaaaccgaactcgcgaaaaaacaaaaagaacacatcaccactattgttggccgctacaaaggcaaacttgccgcgtgggatgtggtgaatgaagctgtcggcgatgacaacaaaatgcgcgatagtcactggtataaaatcatgggcgatgattttctcgttaatgcatttaaccttgctcatgaagtagatccgaaggcgcatctgatgtacaacgactacaacaacgagcgcccggaaaaacgccaggcgactatcgatatgatcaagcgtctgcaacaacgcggtacaccaatccatggtttgggcatgcaagcgcatatcggattggaaaccaatatgcaggattttgaagatagtattctcgcctattcagcattgggtttaaaaatccatctcaccgaactagatatagatgtgctgccctctgtatggaatttaccggtggccgaaatttctacccgctttgaatacaagccggaacgcgatccttatacaaaaggtttgccgaaagagattgatgaaaaacttgcaaaagcctatgaatcgctatttaaaatattgcttaaacatcgcgacaaaatagatagagttacgttttggggcgtaagcgatgatgccagctggctcaatgatttcccaatcaatggcagaaccaactatccgttattgtttaaccgtcaacgccaacctaaagctgcttatttccgtttgctggatttaaaacgctag

SEQ ID NO: 142 - protein, 377 aa, Unknown
  Obtained from an environmental sample
  SIGNAL (1)...(25)
MNISRRQLLALTGATAAITAAKLQAAEKASAATGLRDAYKNDFLIGAALSASIIQQQDPQLVALINKDFNSITPENCMKWGEMRNDDGSWKWQDADAFVEYGSKYKLHMVGHTLGWHSQIPDSVFKNKDGSYISKTELAKKQKEHITTIVGRYKGKLAAWDVVNEAVGDDNKMRDSHWYKIMGDDFLVNAFNLAHEVDPKAHLMYNDYNNERPEKRQATIDMIKRLQQRGTPIHGLGMQAHIGLETNMQDFEDSILAYSALGLKIHLTELDIDVLPSVWNLPVAEISTRFEYKPERDPYTKGLPKEIDEKLAKAYESLFKILLKHRDKIDRVTFWGVSDDASWLNDFPINGRTNYPLLFNRQRQPKAAYFRLLDLKR

SEQ ID NO: 143 - DNA, 3285 bp, Unknown
  misc_feature: Bacterial DNA
atgagtttaaaaataaataaaatcatatcatttatcatagttttttcgatggtttttgggacgttaatgtatgtgccacatctaaaagcatttgcggataataccggtattaatttggtttctaatggtgattttgaatcaggcacaattgatggctggtttaaacaaggtaatccgacattaacagtaacaactgagcaggcaattgggcaatacagtatgaaagttacaggtagaacacagacatatgaaggacccgcatatagctttttggggaaaatgcagaaaggtgaatcatataacgtatcacttaaagttagacttgtttctggacaaaattcatctaatcctttgatcactgtaactatgtttagagaagatgacaatggcaatcattatgacacaatagtttggcaaaaacaagtttctgaagattcatggactactgtaagtgggacttatacattggattatactggaacattaaaaacattatatatgtatgtagaatcacccgatccaacgcttgaatattatattgatgatgttgtagtcacaccgcaaaatccaacgcaaataggaaatgtagttgccaatggaacttttgaaaatgaaaatacttctggatgggttggaacaggttcatctgttgttaaagcagtatatggtgatgctcacagcggagattatagcttattgacgacaggaaggacagctaactggaatggtcctagttatgatttgactggcaaaatagttcccggacaacaatacaatgtggatttttgggtaaaatttattgatggcaatgatacagagcaaatcaaggctactgttaaagcgacttctgacaaagacaattatatacaagttaatgattttgcagatgtaagtaaaggtgaatggacagaaataaaaggcagttttactttacctgttgcagattacagcggcattagcatctatgtggaatctcaaaatcctactttagagttttacattgatgatttttctgtaataggtgaaattgcaaataatcagattactattcaaaatgacattccagatttgtactctgtatttaaagattattttcctataggcgttgcggttgatccaagtagattaaatgatactgatccgcatgctcaattgacggctaaacattttaatatgcttgttgcagaaaacgccatgaaacctgaaagtttacaacccacagaaggaaattttacttttgataatgctgataagattgttgattatgcaatatcacataatatgaagatgagggggcatactttactttggcataatcaagttccagattggtttttccaagatccgtctgacccatccaagcctgcttcgagagatttactattacaaagattaaaaactcatattacaactgtgttagaccattttaaaacaaagtatggttctcagaatccaataattggatgggatgtcgtaaatgaagttcttgatgataatggcagtttgagaaattcgaagtggttgcaaattattggacccgactatatagaaaaagcctttgaatatgcacatgaagcggatccatcgatgaagttgtttattaatgattacaatatcgaaaataatggcgttaaaactcaagctatgtatgacttggtaaaaagattaaagagtgaaggcgttcctatagatggaatagggatgcaaatgcacataaatataaattccaatatagataatataaaagcatcaatagaaaaactggcatcgttaggcgttgaaatacaagtaactgaattagatatgaacatgaacggtaatatatctaacgaagcattgctcaagcaagctagattgtataaacaattatttgacttatttaaagcagagaaacaatatataactgctgtagttttttggggagtttcagacgatgtaacttggcttagcaagccaaatgctccgctactttttgatacaaagttgcaagcaaagccagcatactgggcaatagtagatccgaataaagctacaccagacattcaatctgcaaaggctttggaaggatcaccgacaatgggtacaaatgttgataactcttggaaacttgtaaagccgttatatgcaaatacttttgtagaagggtcggtcggagcaactgctgctgttaagtctatgtgggatactaaaaacttgtatttgttagtacaagtttcagacaataccccatctagtaatgatggtattgagatttttgtagataagaatgatgacaaatccacttcttatgaaactgatgatgaacattatacaattaagagggatggtacagggagttcagatattaccaaatatgtgacttctaatgctgacggatatgtagcacagctagctattccaattgaagatattaatcctgcacttaatgataaaattggatttgacattagaataaatgatgataaaggtattggtaatatagatgcaataacagtttggaacgattatacaaacagtcaagatactaatacatcgtattttggcgatttagtattatcaaaacctgcacaaattgcaacagctatatatggcactcctgttattgatggtaaagtagatgatatttggaataatgttgaagctatttcaacaaatacatgggttttgggttcaaatggtgctactgcgacagcaaaaatgatgtgggacgataagtacctttatgttttggcggatgttacagattcaaatctgaacaaatctagtgttaatccatatgaacaagattctgtagaagtttttgtagatcaaaataatgacaagacgacatattataaaaatgatgatggacagtttagagttaactatgacaatgaacaaagctttgggggaagcactaattcaaatggatttaaatcggcaactagtcttacacaaagtggatatattgtagaagaagctattccttggacgagtatcactccatcaaatggcactatcataggatttgacttgcaagttaatgatgcagatgaaaatggtaagaggacaggtattgtaacatggtgtgatccgagcggaaattcatggcaagatacttctgggtttgggaatttattgcttacaggtaaaccatccggtgttggtacaaaaagaatggcgtttaacgacataaaagacagttgggcaaaagatgcaatagaagtattagcatcaaggcacatagtagaaggtatgacagacactcagtatgaaccaaacaagacagtaacgagagcggaataa

SEQ ID NO: 144 - protein, 1094 aa, Unknown
  DOMAIN (1)...(1094): Bacterial protein
  SIGNAL (1)...(32)
MSLKINKIISFIIVFSMVFGTLMYVPHLKAFADNTGINLVSNGDFESGTIDGWFKQGNPTLTVTTEQAIGQYSMKVTGRTQTYEGPAYSFLGKMQKGESYNVSLKVRLVSGQNSSNPLITVTMFREDDNGNHYDTIVWQKQVSEDSWTTVSGTYTLDYTGTLKTLYMYVESPDPTLEYYIDDVVVTPQNPTQIGNVVANGTFENENTSGWVGTGSSVVKAVYGDAHSGDYSLLTTGRTANWNGPSYDLTGKIVPGQQYNVDFWVKFIDGNDTEQIKATVKATSDKDNYIQVNDFADVSKGEWTEIKGSFTLPVADYSGISIYVESQNPTLEFYIDDFSVIGEIANNQITIQNDIPDLYSVFKDYFPIGVAVDPSRLNDTDPHAQLTAKHFNMLVAENAMKPESLQPTEGNFTFDNADKIVDYAISHNMKMRGHTLLWHNQVPDWFFQDPSDPSKPASRDLLLQRLKTHITTVLDHFKTKYGSQNPIIGWDVVNEVLDDNGSLRNSKWLQIIGPDYIEKAFEYAHEADPSMKLFINDYNIENNGVKTQAMYDLVKRLKSEGVPIDGIGMQMHININSNIDNIKASIEKLASLGVEIQVTELDMNMNGNISNEALLKQARLYKQLFDLFKAEKQYITAVVFWGVSDDVTWLSKPNAPLLFDTKLQAKPAYWAIVDPNKATPDIQSAKALEGSPTMGTNVDNSWKLVKPLYANTFVEGSVGATAAVKSMWDTKNLYLLVQVSDNTPSSNDGIEIFVDKNDDKSTSYETDDEHYTIKRDGTGSSDITKYVTSNADGYVAQLAIPIEDINPALNDKIGFDIRINDDKGIGNIDAITVWNDYTNSQDTNTSYFGDLVLSKPAQIATAIYGTPVIDGKVDDIWNNVEAISTNTWVLGSNGATATAKMMWDDKYLYVLADVTDSNLNKSSVNPYEQDSVEVFVDQNNDKTTYYKNDDGQFRVNYDNEQSFGGSTNSNGFKSATSLTQSGYIVEEAIPWTSITPSNGTIIGFDLQVNDADENGKRTGIVTWCDPSGNSWQDTSGFGNLLLTGKPSGVGTKRMAFNDIKDSWAKDAIEVLASRHIVEGMTDTQYEPNKTVTRAE

SEQ ID NO: 145 - DNA, 1629 bp, Eukaryote
atgaagattgtggatacaacttccgcagagataaagattgaaatggaacctgaaaaagagatacctgctctgaaagaagtactaaaagactacttcaaagtcggagttgcactgccgtccaaggtcttcctcaacccgaaggacatagaactcatcacgaaacacttcaacagcatcaccgcagaaaacgagatgaaaccggatagtctgctcgcgggcatcgaaaacggtaagctgaagttcaggtttgaaacagcagacaaatacattcagttcgtcgaggaaaacggcatggttataagaggtcacacactggtgtggcacaaccagacacccgactggttcttcaaagacgaaaacggaaacctcctctccaaagaagcgatgacggaaagactcaaagagtacatccacaccgttgtcggacacttcaaaggaaaagtctacgcatgggacgtggtgaacgaagcggtcgatccgaaccagccggatggactgagaagatccacctggtaccagatcatggggcctgactacatagaactcgccttcaagttcgcaagagaagcagatccagatgcaaaactcttctacaacgactacaacacattcgagcccagaaagagagatatcatctacaacctcgtgaaggatctcaaggagaagggactcatcgatgggataggcatgcagtgtcacatcagtcttgcaacagacatcaaacagatcgaagaggccatcaaaaagttcagcaccatacccggtatagaaattcacatcacagaactcgatatgagtgtctacagagattccagttccaactacccagaggcaccgaggacggcactcatcgaacaggctcacaaaatgatgcagctctttgagattttcaagaagtacagcaacgtgatcacgaacgtcacattctggggtctcaaggacgattactcctggagagcaacaagaagaaacgactggccgctcatcttcgacaaagatcaccaggcgaaactcgcttactgggcgatagtggcacctgaggtccttccaccacttccaaaagaaagcaggatctccgaaggcgaggctgtggtagtggggatgatggatgactcgtacctgatgtcgaagccgatagagatccttgacgaagaagggaacgtgaaggcaacgatcagggcggtgtggaaagacagcacgatctacatctacggagaggtacaggacaagacgaaaaaaccagcagaagacggagtggccatattcatcaacccgaacaacgaaagaacaccctatctgcagcctgatgacacctacgctgtgctgtggacaaactggaagacggaggtcaacagagaagacgtacaggtgaagaaattcgttgggcctggctttagaagatacagcttcgagatgtcgatcacgataccgggtgtggagttcaagaaagacagctacataggattcgacgctgcggtgatagacgacgggaagtggtacagctggagcgacacgacgaacagccagaagacgaacacgatgaactacggaacgctgaaactcgaaggaataatggtagcgacagcaaaatacggaacaccggtcatcgatggagagatagacgagtaa

SEQ ID NO: 146 - protein, 542 aa, Eukaryote
MKIVDTTSAEIKIEMEPEKEIPALKEVLKDYFKVGVALPSKVFLNPKDIELITKHFNSITAENEMKPDSLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFEPRKRDIIYNLVKDLKEKGLIDGIGMQCHISLATDIKQIEEAIKKFSTIPGIEIHITELDMSVYRDSSSNYPEAPRTALIEQAHKMMQLFEIFKKYSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYAVLWTNWKTEVNREDVQVKKFVGPGFRRYSFEMSITIPGVEFKKDSYIGFDAAVIDDGKWYSWSDTTNSQKTNTMNYGTLKLEGIMVATAKYGTPVIDGEIDE

SEQ ID NO: 147 - DNA, 1146 bp, Unknown
  Obtained from an environmental sample
atgactttctctcgacggcaatttttgctgcaaacctccgccggcctggcacttttgagcactgccaaaatgcgcgctttcgcccgcgcagtcgatgaagtgggccttaaagaccattttaaagaccattttcatattgggactgccatcagcggtcgactgatgacggaaatgccggccttttaccgcgacctggttacccgtgaattcagtgccattaccatggaaaacgacatgaaatgggagcgtctgcatcccaaagaaggccaatgggattgggagattgccgacaaattcgtcaattttggcgaagaaaacgacatgtacattgtcgggcatgttctggtctggcactcacagaccccggattgggtgttccaggattccagaggcaagcccatttctcgcgacgctttgctgaaacgcatgcgccaccagattgaacagatggcgggccgctataagggccgggtacacgcgtgggatgtggtcaatgaggcggtggacgaggaccaaggctggcgcaaaagcccgtggtttaacattattgggcccgagtttatggagcacgccttcaattacgcccacgaagtggaccccgacgctcacctgttgtacaacgactacaatatgcacggtcgggaaaaacgcgaattcgtcctggatttcatcaaaagatacaagaaaaaaggcattccgatccagggcataggcatgcaaggccatgtgggcctgagctttcccgatatcagcgagtttgagaaaagcctgcaagcctacgccaaacagggcatgcggatgcacattaccgagctggatatggacgtgttaccagtggcctgggatcacattggcgccgagatttccaccgagtttgactacgctgatgaactggacccctggcccaaagggctgccggaagaagtcgaacaggaatttaccgatcgctacaccgctttctttaaactgtttttgaaataccgcgatgatattgaaagggtcaccttctggggaaccggagatgcggaatcgtggaaaaataatttcccagtaagggggcgcaccaactacccgctgctgtttgatcgccgataccgcagaaaaccggcctatgattcgattgtcgaactgaccaaaaacctttaa

SEQ ID NO: 148 - protein, 381 aa, Unknown
  Obtained from an environmental sample
  SIGNAL (1)...(28)
MTFSRRQFLLQTSAGLALLSTAKMRAFARAVDEVGLKDHFKDHFHIGTAISGRLMTEMPAFYRDLVTREFSAITMENDMKWERLHPKEGQWDWEIADKFVNFGEENDMYIVGHVLVWHSQTPDWVFQDSRGKPISRDALLKRMRHQIEQMAGRYKGRVHAWDVVNEAVDEDQGWRKSPWFNIIGPEFMEHAFNYAHEVDPDAHLLYNDYNMHGREKREFVLDFIKRYKKKGIPIQGIGMQGHVGLSFPDISEFEKSLQAYAKQGMRMHITELDMDVLPVAWDHIGAEISTEFDYADELDPWPKGLPEEVEQEFTDRYTAFFKLFLKYRDDIERVTFWGTGDAESWKNNFPVRGRTNYPLLFDRRYRRKPAYDSIVELTKNL

SEQ ID NO: 149 - DNA, 1044 bp, Unknown
  Obtained from an environmental sample
atgaagaagctttttgtcgcggtcgttttgttgcccttagcaacttttttcgcgtcggacggattggagggagaacctttgagatcgttagccgagaaacttggcatctacatcggttacgcttcgatcaaccatttctggactcttccggattcaaacaagtacacagaagtggcaaagagggagttcaacatactcacgccagagaaccaaatgaagtgggacagccttcacccagagcctgacaggtacaacttcacttacgcagagcgtcatgtcgagttcgctttggaaaacaacatgctcgttcacggccacacactcgtttggcacaaccaacttccgttctggttgaacagacagtggaccaaagaagaactcctgaaagtccttgaggaccacatcaaaacagtcgtcggtcacttcaaaggaagggtgaagatttgggacgtggtgaacgaagcggtcagcgacatgggcagttacagagagaccatttggtacaagaccatcggacccgagtacatcgaaaaggcattcgtgtgggcaagacaagccgatccggaagcgatcctcatatacaacgactacaatatagaaacgatcaatcccaaatcgaatttcacctaccagctcatcaaggagctgaaagaaaaaggtgtgccgatagacggcatcggttttcaaatgcacatagacatcaacggaataaactatgacagtttcagaaacaacctgaagaggttcgctgatctcggtctgaagctctacatcacggaaatggatgtgagaatacccaagaacgcaactgaaaaagacttggacagacaggcagaaatctacgcgaagatcttcgaaatctgcttagagaatcctgcggtccaagccatacagttctggggtttcacggacaagtattcctgggtgcctggctttttcagcgggtacgatcatgcgctgatctttgacagggactacagccccaagcccgcgtattttgcgataaagagggtgctcgaagccaaggtgagcaagggacgctga

SEQ ID NO: 150 - protein, 347 aa, Unknown
  Obtained from an environmental sample
  SIGNAL (1)...(18)
MKKLFVAVVLLPLATFFASDGLEGEPLRSLAEKLGIYIGYASINHFWTLPDSNKYTEVAKREFNILTPENQMKWDSLHPEPDRYNFTYAERHVEFALENNMLVHGHTLVWHNQLPFWLNRQWTKEELLKVLEDHIKTVVGHFKGRVKIWDVVNEAVSDMGSYRETIWYKTIGPEYIEKAFVWARQADPEAILIYNDYNIETINPKSNFTYQLIKELKEKGVPIDGIGFQMHIDINGINYDSFRNNLKRFADLGLKLYITEMDVRIPKNATEKDLDRQAEIYAKIFEICLENPAVQAIQFWGFTDKYSWVPGFFSGYDHALIFDRDYSPKPAYFAIKRVLEAKVSKGR

SEQ ID NO: 151 - DNA, 1131 bp, Unknown
  Obtained from an environmental sample
atgcgatctatgccactttatgtgttgttatgcagcgcccttctgaccggcagcctatatgcacaagaccaaaatgcttctttaaaacaggcctttagcaaaaactttagtattggcacagccttaagtgctacacaaattcagggcaaagagccgggcacactggaattggtaacacagcaatttaacgcggtgacggcagaaaacgtgatgaagtgggaaatcattgaacctgtggaaggccagttcaactttgctgccgccgacgccatgattgaattcgccgaagccaatcatatcaaggtgataggccatgtgctgttatggcacgaacaaacaccagcctgggtatttctggacgccaaaggccaggccgcctcaaaggaactggtgttatcacggctaaaaaaccatatcaatgccgtaatgggccgctacaaaggccgtattcatggctgggatgcagtcaacgaagccttaaatgaagacggcactctgcgccaatccaactggtataaagctttaggcgacgactatatagccacagtctttgaactggcgcatcaggccgacccgaaagccgaactctattacaacgacttcaatttatttaaaccggaaaaacgcgctggtgtactcaaactggtggcagctttaaaagcgaaaaatgtgcctatccacggcataggcgagcaaggccattacagcctggattaccctgagctgcagcaagtagaagactctattgtggcttttaaaaacactggcctgaaagtggtgattaccgaactggatatctcagttttacccttccctgagccagaaaagattggtgctgatatctcactcaatatgcagttaaaacaagaacttaatccctacgccgatggcttacccaaagaagtcagcgatcaactgacagaaaaatacctgcaattatttcagctatttttacgccacagcgacgccatcgaacgcgtgaccttatggggcgtaaacgacaaccaaacctggcgcaacaactggccaatgaaaggcagaacagactaccccttactcttcgaccggaaaaaccagccaaaagaagtggttcctgcattgattaaactggcggaaaaagctggtaaataa

SEQ ID NO: 152 - protein, 376 aa, Unknown
  Obtained from an environmental sample
  SIGNAL (1)...(21)
MRSMPLYVLLCSALLTGSLYAQDQNASLKQAFSKNFSIGTALSATQIQGKEPGTLELVTQQFNAVTAENVMKWEIIEPVEGQFNFAAADAMIEFAEANHIKVIGHVLLWHEQTPAWVFLDAKGQAASKELVLSRLKNHINAVMGRYKGRIHGWDAVNEALNEDGTLRQSNWYKALGDDYIATVFELAHQADPKAELYYNDFNLFKPEKRAGVLKLVAALKAKNVPIHGIGEQGHYSLDYPELQQVEDSIVAFKNTGLKVVITELDISVLPFPEPEKIGADISLNMQLKQELNPYADGLPKEVSDQLTEKYLQLFQLFLRHSDAIERVTLWGVNDNQTWRNNWPMKGRTDYPLLFDRKNQPKEVVPALIKLAEKAGK

SEQ ID NO: 153 - DNA, 1020 bp, Unknown
  Obtained from an environmental sample
atgggtgctatgggcctggcggcgctgtattcgctgccagccaatgcacagacctgcattacgcagagtcagacgggcaccaacaacggccactatttttcgttctggaaggacaatccgggaacggtcaatttctgtatgtatgccaacggccgttacacgtctaactggaacggcatcaacaattgggtcggcggcaaaggctggcaaaccggctcgcgcagaaacgtcacctactctggctcgttcaactctcccggcaatggctatctggctgctctactggctggaccaccaatcctgttggtcgagtactacatcatcgagagctggggaaattggcgcccgccgggttcggatggaacattgttaggcaccgtcactagcgacggcggtacttacgatatctatcgctcgcgccgcaccaacgcgccttgtatcactggcaactcctgtaacttcgatcagtactggagcgtacggcaatccaagcgcgtgggcggcacgattaccacgggcaatcacttcgacgcttgggcggcacgcggcttgaacctcggcacgcacaactaccaagtgatggcgaccgagggatatcagagcaacggcagctccgacatcaccattagcgacaacccgggaccgacgccaggacccactccgaacccgaatcccacgccgggcaccaagaatttcacggtgcgcgcgcgcggaaccgcggggggtgagtccatcacgctgcgtgtgaacaatcagaacgtgcagacctggacgctgtcgaccagctaccagaacttcacggcgtccacgacgttgagtggtggcatcacggtcgcgttcaccaatgatggtggtagtcgagacgttcaggtggattacatccaggtgaacggcgcaactcgacaatccgagagccagacgtacaacaccggcctctatgccaacggcagttgcggcggcggctcgaacagcgagtggatgcattgcaatggagcgatcggctacggcaacacgccgtag

SEQ ID NO: 154 - protein, 339 aa, Unknown
  Obtained from an environmental sample
  SIGNAL (1)...(16)
MGAMGLAALYSLPANAQTCITQSQTGTNNGHYFSFWKDNPGTVNFCMYANGRYTSNWNGINNWVGGKGWQTGSRRNVTYSGSFNSPGNGYLAALLAGPPILLVEYYIIESWGNWRPPGSDGTLLGTVTSDGGTYDIYRSRRTNAPCITGNSCNFDQYWSVRQSKRVGGTITTGNHFDAWAARGLNLGTHNYQVMATEGYQSNGSSDITISDNPGPTPGPTPNPNPTPGTKNFTVRARGTAGGESITLRVNNQNVQTWTLSTSYQNFTASTTLSGGITVAFTNDGGSRDVQVDYIQVNGATRQSESQTYNTGLYANGSCGGGSNSEWMHCNGAIGYGNTP

SEQ ID NO: 155 - DNA, 1836 bp, Unknown
  Obtained from an environmental sample
atgaaaggattaattgcggcagcgcttgctggcttggcattcggggcctccctatcctggggacagtgcacaacgtttaccaccagtaccattcagaattgtaatggcattgattacgagctctggagtcagaataacaagggcaccgtaagcatgaagattacgggagggagcacgaatccgaatggaggaactttcgatgctacctggaatggcaccgagaatatcctggctagagctggtaagaaatggggctcgtccagcactaccacccccacgtccgcaggcaatattactcttgaattcgcggcgacatggtcctcaagcgataacgtaaaaatgcttggagtctatggctgggcgtactatccaactggaagtatcccgactaaacaggaaaatggagcaagtacctcattcacaaatcaaattgagtactacatcatccaggatcgtggtagctataatgctgcatcgggtggaacgaactccaaaaaatacggcgaagggacgatcgatggaattctgtatgaattctatatcgcagacagaatcaaccagcctgatctgtcaggaaagagtggaaacttcaagcaatacttcagcgtcccgaaaagtacgagcagccataggcaaagtgggacgattaccgtttccaaacatttccaggcctgggaaaatgccggaatgaaaatgatgtcctgtcgcttgtatgaagtcgcaatgaaagtcgagtcctataccggttctgcgaccggtgttggctctgcgaaggttacaaagaatatactcaccattggtggaatcttgagcagtagcagtactgcaagcagtagcagcacagtaagtagcagtagcagcaatgcatatacgcttgtcacgaatgtttctcccgctggagccggaacagtgaccaggagccccaatactgcgacctatgccccgaatgcttcagtacagcttactgcaacgccgagtaccggttggaaatttgtcggttgggctggggatcttacgtcaactacgagtactgctaccgtcaccatgaccaaagatattaccgcaactgcaaaatttgaactggtatcgggagatggcacgaccaacttgatcaaggatggaaacttccccagtagcagcgtcatctccacaggtgatggcacctcctggaagctcgggcaaggtacaaactggggtaattccgcagcaacgacgagtgtcagcaatggaatcgcgactgtcaatgtgaccaccattggatctcaaacctatcaaccccagctaattcagtataacgtggctctttacaaggatatgagctacaagctcaccttcaaggcaaaagctgctgctgcaaggaaaattgaagtcgcattccaacagtcggtggacccatgggctggatatgcttccaaggaattcgatcttacaacgacagagcagacatatgagttcgtatttaaaatgactagcgctactgacacggcttcacagttcgcgttcaatctcggccaggcaacaggcgccgtcaatattagtgatgtaaagctagtatatacgacagctggtacaacacccgtattccgtggatataatgaggcggcaacacaggagaggcctgtattcatatccttggatggtaggacgttgaacattgttccagtgtatggagccaaactgcaggtcaagttagtggacatcaatggtaagatgagagcctccttcaatgtggtcggaattgcttccatcccgctgtccaatatccccgctgggcggtattatattgacgtaagtggtgacggcgttaagcaggcatccccgatagttctggaataa

SEQ ID NO: 156 - protein, 611 aa, Unknown
  Obtained from an environmental sample
  SIGNAL (1)...(21)
MKGLIAAALAGLAFGASLSWGQCTTFTTSTIQNCNGIDYELWSQNNKGTVSMKITGGSTNPNGGTFDATWNGTENILARAGKKWGSSSTTTPTSAGNITLEFAATWSSSDNVKMLGVYGWAYYPTGSIPTKQENGASTSFTNQIEYYIIQDRGSYNAASGGTNSKKYGEGTIDGILYEFYIADRINQPDLSGKSGNFKQYFSVPKSTSSHRQSGTITVSKHFQAWENAGMKMMSCRLYEVAMKVESYTGSATGVGSAKVTKNILTIGGILSSSSTASSSSTVSSSSSNAYTLVTNVSPAGAGTVTRSPNTATYAPNASVQLTATPSTGWKFVGWAGDLTSTTSTATVTMTKDITATAKFELVSGDGTTNLIKDGNFPSSSVISTGDGTSWKLGQGTNWGNSAATTSVSNGIATVNVTTIGSQTYQPQLIQYNVALYKDMSYKLTFKAKAAAARKIEVAFQQSVDPWAGYASKEFDLTTTEQTYEFVFKMTSATDTASQFAFNLGQATGAVNISDVKLVYTTAGTTPVFRGYNEAATQERPVFISLDGRTLNIVPVYGAKLQVKLVDINGKMRASFNVVGIASIPLSNIPAGRYYIDVSGDGVKQASPIVLE

SEQ ID NO: 157 - DNA, 645 bp, Unknown
  Obtained from an environmental sample
atgtttaagttaagtaagaaaattttgatggtgttattaacaatttcaatgagttttattagcttatttgcagtaaccgcgtatgcagcttcgacagactactggcaaaattggactgatggtggtgggacagtaaatgctaccaatggatctgatggcaattacagtgtttcatggtcaaattgcgggaattttgttgttggtaaaggctggactaccggatcagcaactagggtaataaactataatgccggagccttttcgccgtccggcaatggatatttagctctttatgggtggacgagaaattcactcatagaatattacgtcgttgatagctgggggacttatagacctactggaacttataaaggcactgtgactagtgatggagggacatatgacatatacacgactacacgaaccaacgcaccttccattgacggcaataatacaaatttcacccagttctggagtgttaggcagtcaaagagaccgattggtaccaacaataccatcacttttagcaaccacgttaacgcctggaagagtaaaggaatgaatctggggagtagttgggcttatcaggtattagcgacagagggatatcaaagtagtgggtactctaacgtaacggtctggtaa

SEQ ID NO: 158 - protein, 214 aa, Unknown
  Obtained from an environmental sample
  SIGNAL (1)...(29)
MFKLSKKILMVLLTISMSFISLFAVTAYAASTDYWQNWTDGGGTVNATNGSDGNYSVSWSNCGNFVVGKGWTTGSATRVINYNAGAFSPSGNGYLALYGWTRNSLIEYYVVDSWGTYRPTGTYKGTVTSDGGTYDIYTTTRTNAPSIDGNNTNFTQFWSVRQSKRPIGTNNTITFSNHVNAWKSKGMNLGSSWAYQVLATEGYQSSGYSNVTVW

SEQ ID NO: 159 - DNA, 1041 bp, Unknown
  Obtained from an environmental sample
atgatcagtctcaaacgagtggcggcgctcctgtgcgtcgcaggtctgggcatgtctgcggcaaacgcgcagacctgcctcacgtcgagtcaaaccggcactaacaatggcttctattattccttctggaaggacagtccgggcacggtgaatttttgcctgcagtccggcggccgttacacatcgaactggagcggcatcaacaactgggtgggcggcaagggatggcagaccggttcacgccggaacatcacgtactcgggcagcttcaattcaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagtgaaggcggtagcagcagtggtggcggaagcagcacgagcagcagcagcggcggtggtggcaccaagagcttcacggttcgtgcgcgcggtaccgcgggcggtgagtccatcacgctgcgcgtgaacaaccagaacgtgcagacctggacgctgggcaccagcatgacgaactacacggcgtcgacttcactgagcggcggcatcaccgtggtgtacacgaacgacagcggtaaccgcgacgtgcaggtggactacatcgtcgtgaacggccagacgcgccagtccgaagcccagagctacaacaccggcctttatgcgaacgggcgttgcggcggtggctccaacagcgaatggatgcattgcaacggcgccatcggctacggcaatacaccgtaa

SEQ ID NO: 160 - protein, 346 aa, Unknown
  Obtained from an environmental sample
  SIGNAL (1)...(23)
MISLKRVAALLCVAGLGMSAANAQTCLTSSQTGTNNGFYYSFWKDSPGTVNFCLQSGGRYTSNWSGINNWVGGKGWQTGSRRNITYSGSFNSPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSEGGSSSGGGSSTSSSSGGGGTKSFTVRARGTAGGESITLRVNNQNVQTWTLGTSMTNYTASTSLSGGITVVYTNDSGNRDVQVDYIVVNGQTRQSEAQSYNTGLYANGRCGGGSNSEWMHCNGAIGYGNTP

SEQ ID NO: 161 - DNA, 1047 bp, Unknown
  Obtained from an environmental sample
atgttcaaaggtcttttgaaatcggtcctcaccggcaagcgagccggtgcggtgttcatctgtctggccggactgtggatgacacaggcgcaggcgcagacgtgcatcggttcaccacaaacgggcaacaacggcggcttcttcttttcgttctggaaagacaatccggggtcggtgaatttctgcatgtactccggcggtcgctatacctccagctggagcggcatcaacaactgggtaggtgggaagggctggcaaaccggttcatcccgcacggtgacgtattcgggcacgttcaactcgccgggaaacggctacctgactctgtacggatggaccaccaatccgctggtcgagtactacatcgtggacagctggggcagctaccgtccgcctggaggccagggcttcatgggcacggtcaccagcgacggcggaacgtatgacatctaccgggttcgccgcaccaatgcgccgtgcatcacaggcaacaactgcaacttcgaccagtactggagcgtgcgtcagtcgaggcgggtgggcggcaccatcaccaccgccaaccatttcaacgcgtggcgtacgctcggcatgaatctcgggcagcacaactaccaggtgatggcgaccgaaggattccagagcagtggcagctcggacatcaccgtgagcgaaggatctggcggtggcggcggaggtggcggcggtggcaccaagagcttcacggtgcgcgcgcgcggcaccgcgggcggcgagtccatcacgctgcgcgtcaacaaccaggtcgtgcagagctggaccttgagcaccagcatgcagaactacacggcctcgaccacgatgagcggcggcatcacggtgaacttcaccaacgacggcaccaaccgcgacgtgcaggtggactacatcatcgtgaatggccagacgcgtcagtccgaagcgcagacgtacaacaccgggctgtacgccaacggccgttgcggtggcgggtcgaacagcgagtggatgcattgcaatggcgcgatcgggtacggcgacacgccctga

SEQ ID NO: 162 - protein, 348 aa, Unknown
  Obtained from an environmental sample
  SIGNAL (1)...(32)
MFKGLLKSVLTGKRAGAVFICLAGLWMTQAQAQTCIGSPQTGNNGGFFFSFWKDNPGSVNFCMYSGGRYTSSWSGINNWVGGKGWQTGSSRTVTYSGTFNSPGNGYLTLYGWTTNPLVEYYIVDSWGSYRPPGGQGFMGTVTSDGGTYDIYRVRRTNAPCITGNNCNFDQYWSVRQSRRVGGTITTANHFNAWRTLGMNLGQHNYQVMATEGFQSSGSSDITVSEGSGGGGGGGGGGTKSFTVRARGTAGGESITLRVNNQVVQSWTLSTSMQNYTASTTMSGGITVNFTNDGTNRDVQVDYIIVNGQTRQSEAQTYNTGLYANGRCGGGSNSEWMHCNGAIGYGDTP

SEQ ID NO: 163 - DNA, 1068 bp, Unknown
  Obtained from an environmental sample
atgaaagcaaagagaatgaagttgtttgccgcatttttactctgttttacgcttgcacttcctggggcagtgcatgcgcagacgatcaccagcaattcggtcggtacgcatgacggttatgactatgaatactggaaggacagcgggaatggaactatggttctcggtagtggcggtacgttcagtgccgagtggagcaatatcaataatattctgttccgtaaaggcaagaagttcaatgagacgcagacccatcagcaaattggaaacatttccataacctatggtgccacctaccaaccgaatggcaattcgtatttaacggtctatggctggacggttgaccccctcgtcgaatattacattgtcgatagctggggcagctggcgtccgcctggagcatcgccaaaggggactgttaacgttgacggaggaacgtatgacatttatgagacaactcgtgtcaaccagccttccattaaaggcacggcaaccttcaagcagtattggagtgtccggacgtcaaaacggacgagcggaaccatatctgtaagcgagcactttaaggcctgggagaaattggggatgaccatgggcaagatgtatgaagtcgcgcttacggttgaaggctatcaaagcagtggaagcgctaatgtgtatagccatacactgacgatcggcgggggaacaacacctccaccaaccacaggcacaaagatcgaagccgagagtatgaccaaaagcggacaatacactgggaatatcagctcgccgttcaacggagtcgctttgtatgccaacaatgattccgtgaaattcacgcataatttcacgaccggcacccataacttctcactccggggggcatcaaacaactccaatatggcccgggttgacctgaaaatcggcgggcagacgaaggggaccttctatttcggcggaagcagccctgcggtctatactctgaataatgtcagccatggaaccggaaatcaagaggttgaactcgttgtaaccgccgataacggaacatgggatgctttcattgattatctcgagatccattaa

SEQ ID NO: 164 - protein, 355 aa, Unknown
  Obtained from an environmental sample
  SIGNAL (1)...(26)
MKAKRMKLFAAFLLCFTLALPGAVHAQTITSNSVGTHDGYDYEYWKDSGNGTMVLGSGGTFSAEWSNINNILFRKGKKFNETQTHQQIGNISITYGATYQPNGNSYLTVYGWTVDPLVEYYIVDSWGSWRPPGASPKGTVNVDGGTYDIYETTRVNQPSIKGTATFKQYWSVRTSKRTSGTISVSEHFKAWEKLGMTMGKMYEVALTVEGYQSSGSANVYSHTLTIGGGTTPPPTTGTKIEAESMTKSGQYTGNISSPFNGVALYANNDSVKFTHNFTTGTHNFSLRGASNNSNMARVDLKIGGQTKGTFYFGGSSPAVYTLNNVSHGTGNQEVELVVTADNGTWDAFIDYLEIH

SEQ ID NO: 165 - DNA, 1047 bp, Unknown
  Obtained from an environmental sample
gtggggcgcaggagcgccgccacggcattcatcggcctggcagcgctgtgtgcctcggccgccaacgcgcagacctgtctgagctcgagtcagaccggcaccaacaacggcttctactattcgttctggaccgacggcggtggctccgtgcagttctgcctgcaatccgccgggcgctacacctccagctggagcaatgtcggaaactgggtcggtggcaagggctggcagaccggcgcgcgccgcaacatcaactattccggcagcttcaatccctcgggtaacgcgtacctggccgtctatggctggaccacgaatcccctggtggagtactacatcgtcgacaactggggtacctatcgtccaccgggtgggcagggattcatgggcacggttgtcagcgatggcggcacctacgacgtctaccgcacgcaacgggtcaacgcgccctccattcagggcaacgcgaccttctaccagtactggagcgttcgccagtcgaagcgcaccggtggaaccatctccaccggcaaccatttcgacggctgggcgacgttcggcatgaacctgggaaccttcaattaccagatcgtggcgaccgagggctaccagagcagcggcaattccgacatcacggtgagcgatggcggcagcagctcctcgtcctccagcagcagcagttcgtcgtcctccagcagcggcggtggcggcaccaagagcttcacggtgcgcgcgcgcggcacggccggaggcgagtcgatcagcctgcgggtcaacaacaccaacgtgcagacctggtcgctgaccaccagctaccagaatctcacggcctcgaccacgctgaccggcggcatcaccgtcaactacaccaacgacagcagcggtcacgacgtacaggtggactacatcatcgtgaacggccagacccgccagtccgaggcgcagagctacaacaccggactctatgccaacgggcgctgcggtggtggtggctacagcgagtggatgcattgcaacggcgccatcggctacggcaatacgccgtaa

SEQ ID NO: 166 - protein, 348 aa, Unknown
  Obtained from an environmental sample
  SIGNAL (1)...(23)
VGRRSAATAFIGLAALCASAANAQTCLSSSQTGTNNGFYYSFWTDGGGSVQFCLQSAGRYTSSWSNVGNWVGGKGWQTGARRNINYSGSFNPSGNAYLAVYGWTTNPLVEYYIVDNWGTYRPPGGQGFMGTVVSDGGTYDVYRTQRVNAPSIQGNATFYQYWSVRQSKRTGGTISTGNHFDGWATFGMNLGTFNYQIVATEGYQSSGNSDITVSDGGSSSSSSSSSSSSSSSSGGGGTKSFTVRARGTAGGESISLRVNNTNVQTWSLTTSYQNLTASTTLTGGITVNYTNDSSGHDVQVDYIIVNGQTRQSEAQSYNTGLYANGRCGGGGYSEWMHCNGAIGYGNTP

SEQ ID NO: 167 - DNA, 669 bp, Unknown
  Obtained from an environmental sample
gtgaagctgaaaagactgttcaagatcggactgctgccggccgtattgttgtttagtgcaacgcagcagttaaccgcgcaaaccatctgcagcaaccagaccggcaccaacaacggctacttctactcgttctggaaggacaccgggtcggcgtgcatgacactgggttccggcggcaactacagcgtcaactggaacctgggttccgggaacatggtctgcggcaaaggctggagtaccggatcttcaagccgcagaatcggctacaacgccggcgtctgggcgccgaacggcaatgcctacctgactctgtatgggtggaccaggaacccgctcatcgagtactacgtggtcgacagttggggaagctggaggccgccaggcggaacctccgcgggcaccgtcaatagcgatggcgggacctacaacctctatcggacgcagcgggtcaacgcgccttccatcgacggcacccggacgttctatcagtactggagtgtccggacctcgaagaggcccaccgggagcaaccagaccatcaccttcgcgaaccacgtgaatgcgtggaggagcaaagggtggaatctggggagtcacgtctaccagataatggcaacagagggatatcaaagcagcgggaattccaacctgacggtgtgggcgcagtag

SEQ ID NO: 168 - protein, 222 aa, Unknown
  Obtained from an environmental sample
  SIGNAL (1)...(36)
VKLKRLFKIGLLPAVLLFSATQQLTAQTICSNQTGTNNGYFYSFWKDTGSACMTLGSGGNYSVNWNLGSGNMVCGKGWSTGSSSRRIGYNAGVWAPNGNAYLTLYGWTRNPLIEYYVVDSWGSWRPPGGTSAGTVNSDGGTYNLYRTQRVNAPSIDGTRTFYQYWSVRTSKRPTGSNQTITFANHVNAWRSKGWNLGSHVYQIMATEGYQSSGNSNLTVWAQ

SEQ ID NO: 169 - DNA, 1041 bp, Unknown
  Obtained from an environmental sample
atgattgttagtttcaagagcgtgaaggcactcgcgtgcctcgccgtgctcggcattaccgccgcgcaggcgcaaacctgcatcacttccagccagaccggtaccaacaacggcaactacttttccttctggaaggacagcccgggtaccgtcaacttctgcatgtatgccaatgggcgctacacctccaactggagcggcatcaacaactgggtgggcggcaagggctggcagacgggctccaaccgcacggtgacctactccggttcgttcaattcgcccggcaatggctatctcaccttgtacggatggaccacgaatccattgatcgagtactacatcgtcgacagctggggcacctatcgaccgccgggcggccagggcttcatgggcaccgtcaacagcgatggcggcacctatgacatctaccgcacgcagcgcgtgaaccagccttccatcatcggcaccgccacgttctaccagtactggagcgtgcggcagtcgaagcgcgtcggcggcacgatcaccacggccaaccacttcaacgcctgggccacgctgggcatgaacctgggccagcacaactaccaggtcatggccaccgagggttaccagagcagtggcagctccgacatcaccgtgaccgagggcggcggctcctcgtcgtccagtggcggcggcagcaccagcagtggcggtggcggcagcaagagcttcaccgtgcgtgcgcgcggcacggtcggcggcgaaaacatccagctgcaggtcaacaaccagacggtggcgagctggaacctgaccaccagcatgcagaactacaacgcctcgaccagcctgagtggcggcatcaccgtcgtgtacaccaatgacagcggcagccgcgacgtgcaggtggactacatcgtcgtcaacggccagacccgccagtccgaagcccagagctacaacaccgggctctatgccaacggacgttgtggtggcggctcgaacagcgagtggatgcattgcaacggcgcgattggctacggcaacacgccctag

SEQ ID NO: 170 - protein, 346 aa, Unknown
  Obtained from an environmental sample
  SIGNAL (1)...(24)
MIVSFKSVKALACLAVLGITAAQAQTCITSSQTGTNNGNYFSFWKDSPGTVNFCMYANGRYTSNWSGINNWVGGKGWQTGSNRTVTYSGSFNSPGNGYLTLYGWTTNPLIEYYIVDSWGTYRPPGGQGFMGTVNSDGGTYDIYRTQRVNQPSIIGTATFYQYWSVRQSKRVGGTITTANHFNAWATLGMNLGQHNYQVMATEGYQSSGSSDITVTEGGGSSSSSGGGSTSSGGGGSKSFTVRARGTVGGENIQLQVNNQTVASWNLTTSMQNYNASTSLSGGITVVYTNDSGSRDVQVDYIVVNGQTRQSEAQSYNTGLYANGRCGGGSNSEWMHCNGAIGYGNTP

SEQ ID NO: 171 - DNA, 678 bp, Unknown
  Obtained from an environmental sample
atggagttgaaaaaaatatccagaaaaggactgccactagtattcttgtccttgttgttgttcagtgtaacgcagcagtcaaacgcccaaaccatctgcagcaatcaaactggcacaaacaacggtttcttctattcgttttggaaggacaccggatcagcatgcatgactttgggctctggcggcaattacgacgtaagttggaatctgggttctgggaatatggttgtcggcaaaggctggagtaccggatcatcaaccaggagagtaggctacaatgccggcatctggcagccgaacggcaatgcatatttggctctctatgggtggacgagaaacccacttatagaatattacgtcgttgatagctggggcactttcaggccgcctggaggaacgtcaataggctccgtcaccactgatggtggtacataccaaatatatcggacccagcgagtcaacgcgccttccattgacggcgccagaactttttatcagtactggagtgtccggacctcgaagagaccgaccgggagcaaccaaaccatcacctttgcgaatcacgttaacgcgtggaggaatctaggtttgaatctggggagtcatgtttaccagataatggccacagagggatttcatagcagtgggagatctaacctaacggtgtggtcacagtaa

SEQ ID NO: 172 - protein, 225 aa, Unknown
  Obtained from an environmental sample
  SIGNAL (1)...(29)
MELKKISRKGLPLVFLSLLLFSVTQQSNAQTICSNQTGTNNGFFYSFWKDTGSACMTLGSGGNYDVSWNLGSGNMVVGKGWSTGSSTRRVGYNAGIWQPNGNAYLALYGWTRNPLIEYYVVDSWGTFRPPGGTSIGSVTTDGGTYQIYRTQRVNAPSIDGARTFYQYWSVRTSKRPTGSNQTITFANHVNAWRNLGLNLGSHVYQIMATEGFHSSGRSNLTVWSQ

SEQ ID NO: 173 - DNA, 1503 bp, Unknown
  Obtained from an environmental sample
ttgaaaaaactcgcagctgccttatcacttgcaattacctttgccgtaccgacaatagtacaagcacaaggtcccacatggactaccagcacaatacagaaatacaacaactacgactatgaactctggaatgaaaacaatcagggtaccgtttccatgaagctcacaggagataacggtaccgctgccaatgcggtaggcggaacgtttgagtctacttggagtggtacaaagaatgtgcttttccgttccggcagaaagtttaccggtacttcagggcaaagcgttgatggtggcggtgctggcaaaaccgctagtgcttacggcaatataagcattaacttcgccgctacgtggtcttccggtgacgatgtgaagatgcttggcgtatatggttgggcgttttacgcactgccaagtgtaccagacaaacaggaaaacggcacttctactaatttttccaatcaaatagaatactacatcattcaagaccgcggcagctataactcggctacaggtggcaccaactcaaagaaatacggtgaggctaccattgacggcattgcttatgagttccgtgtatgtgatagaatagggcaacctatgttaactggcaacgggaattttaagcagtatttcagtgttcctaaaagcactataaaccaccgcaccagcggtacaatctctgtttccaaacactttgaagaatgggaaaaagtcggcatgaaaatggacggtcccttatacgaagtagcgatgaaagttgaatcctattctggcaatgggaatagtaacggcaatgctaaaattacaaagaatattttgaccattggcggaacaaccacaactcaaagcagttcaagcggaggttcaacggttccagatgaatgtggcgaatataaaaagagtttctgtggtggcttgggatatggaagcgtatattccaatttaaccgcaataccctcaacgggcgactgcttatacatcggagattttgaagtaatccagccagctttgaattcaaccgttgccataaacggtgtggaaaatacctgcggaagcgagtggtcagattgcccttacaatgataaacccgattcaaaaaaagatggcggctattatgtttatgtgaaaacaggctcaattaacaattatgagaataacggttggcaaaacattgtagctaaagcaaaaccggcttgcacaccaccttctagcagttccggtgctgcaccaggttcttcttcttcagacgaagaagacccagagccaattttgaaaaatcgcattcctataactcatttttcccttcaaacgcttagcgataaagccttgcgcatagaagtaaatgctccaactattgtggacatttttgacctgagagggaataaggttaaaagtttgaatgtttacggttcgcaaagggttaaattatccctgccgagcggggtgtattttgccaaagtgcgcgggatgaaaagcgttagatttgtgttgaggtaa

SEQ ID NO: 174 - protein, 500 aa, Unknown
  Obtained from an environmental sample
  SIGNAL (1)...(22)
LKKLAAALSLAITFAVPTIVQAQGPTWTTSTIQKYNNYDYELWNENNQGTVSMKLTGDNGTAANAVGGTFESTWSGTKNVLFRSGRKFTGTSGQSVDGGGAGKTASAYGNISINFAATWSSGDDVKMLGVYGWAFYALPSVPDKQENGTSTNFSNQIEYYIIQDRGSYNSATGGTNSKKYGEATIDGIAYEFRVCDRIGQPMLTGNGNFKQYFSVPKSTINHRTSGTISVSKHFEEWEKVGMKMDGPLYEVAMKVESYSGNGNSNGNAKITKNILTIGGTTTTQSSSSGGSTVPDECGEYKKSFCGGLGYGSVYSNLTAIPSTGDCLYIGDFEVIQPALNSTVAINGVENTCGSEWSDCPYNDKPDSKKDGGYYVYVKTGSINNYENNGWQNIVAKAKPACTPPSSSSGAAPGSSSSDEEDPEPILKNRIPITHFSLQTLSDKALRIEVNAPTIVDIFDLRGNKVKSLNVYGSQRVKLSLPSGVYFAKVRGMKSVRFVLR

SEQ ID NO: 175 - DNA, 1053 bp, Unknown
  Obtained from an environmental sample
atgaagtccattcgcagccgcagcctcgccaccgccgtcctggctggcgccctcggcgtcgcagccgcaggcgcgcaggcgcagacgctcaacaacaattccaccggcacgcacgacggctactactacacgttctggaaggactcgggcagcgcctcgatgaccctccatccgggcggacgctacagctcccagtggaccagcaacaccaacaactgggtcggcgggaaaggctggaatcccggtggcccgcgcgtggtcaactactcgggctactacggggtcaacaacagccagaactcctacctggcgctgtacggctggacccgcaatccgctggtcgagtactacgtgatcgagagctacggctcctacaacccggccagttgcgccggcggggtggactacggcagcttccagagcgatggcgccacctacaacgtacgtcgctgcctgcgccagaacgcgccgtcgatcgaaggcaacaacagcaccttctaccagtacttcagcgtgcgcaatcccaagaagggattcggcaacatctccggcacgatcaccgtcgccaaccacttcaactactgggccagccgcggcctcaacctcggcaaccacgactacatggtgttcgccaccgagggctaccagagccagggcagcagcgacatcaccgtgagttcgggtaccggcggcggcggtggcggcggcaacacgggcagcaagaccatcgtggtgcgcgcgcgcggcaccgccggcggagagaacatctcgctcaaggtcaacaacgccaccatcgccagctggacgctcaccaccagcatggccaactacacggccaccacctcggcatcgggcggctcgctggtggagttcaccaacgacggcggcaaccgcgacgtgcaggtggactacctcagcgtcaatggcgccgtccgccaggccgaggaccagacctacaacaccggcgtgtaccagaacggccagtgcggcggcggcaacggccgcagcgaatggctgcactgcaacggtgccatcggcttcggaaatctctga

SEQ ID NO: 176 - protein, 350 aa, Unknown
  Obtained from an environmental sample
  SIGNAL (1)...(27)
MKSIRSRSLATAVLAGALGVAAAGAQAQTLNNNSTGTHDGYYYTFWKDSGSASMTLHPGGRYSSQWTSNTNNWVGGKGWNPGGPRVVNYSGYYGVNNSQNSYLALYGWTRNPLVEYYVIESYGSYNPASCAGGVDYGSFQSDGATYNVRRCLRQNAPSIEGNNSTFYQYFSVRNPKKGFGNISGTITVANHFNYWASRGLNLGNHDYMVFATEGYQSQGSSDITVSSGTGGGGGGGNTGSKTIVVRARGTAGGENISLKVNNATIASWTLTTSMANYTATTSASGGSLVEFTNDGGNRDVQVDYLSVNGAVRQAEDQTYNTGVYQNGQCGGGNGRSEWLHCNGAIGFGNL

SEQ ID NO: 177 - DNA, 1299 bp, Unknown
  Obtained from an environmental sample
atgaaattgttgaaaacgcacaggcgtgcgattgctgccgcagcactagcggtggcgactgttccaatcgctcatgcgcaaacgcttagctcaaatgccactggaacccagaatggttactactattcgttttggaaggattccggtaacgccaccatgacactcggtgccggtggaaactattcttcatcctggaacagcagcactaacaactgggttggcggtaaaggctggatgccgggtactcggcgcacagtcacctattcgggcagttatagcgcgagtggaaccagctacctcgcactttacggctggactcgaaacccgctgatcgaatattacattgtcgaaaactgggtcaattacaatcctgcgtccggcgcaacgaattatgggactgtcaatattgacggcagcacctaccagctgggccgcagccaacgggttaatcagccatctattgaaggcacggccacgttctaccaatactggagtgtgcgccaaaacaagcgcaccagcggaacgattaatattggagcgcatttcgatgcatgggctgctgtgggcttgaacctggggactcacgattatcagattatggcgaccgagggctaccagagcagcggccagtccaatatcacggtgagcgaaggcagtagcggcagcacgacttcgagcacatccagctccagctcaagtacgagttccagtagttcttccagcagttcttccggcggcggcacaggaagttgtgccggagtgaatgtgtaccccaattggaccgcacgcgactggtctggcggcgcatacaatcacgccaatgccggtgaccaaatggtctatcaaaacaatttgtaccgggcaaactggtacaccaactccacgcctggaagcgatgcctcctggaccagtctcgggtcctgtagcggcggcggtagcaccagttcaacaacgagctcctccagttcctcttccacctcggcgtcgagcagctccaactcatccagcagcagttcaagcagctccagcagcggtggctgtcgggaaatgtgtaactggtacggacagggtatgtatcctctgtgtcagaacaccagcggttggggatgggaaaataaccagaactgtatcggtcgccaaacctgtcaaagtcagaacggcggctccgggggtgtggtgaacagctgtggtaccagcagctcttcgtccagtagcacctcctcatcgagcagttcaagttcgtcgagtggcaccacgtcatcgtcctccggaattcctgcagcccgggggatccactag

SEQ ID NO: 178 - protein, 432 aa, Unknown
  Obtained from an environmental sample
  SIGNAL (1)...(26)
MKLLKTHRRAIAAAALAVATVPIAHAQTLSSNATGTQNGYYYSFWKDSGNATMTLGAGGNYSSSWNSSTNNWVGGKGWMPGTRRTVTYSGSYSASGTSYLALYGWTRNPLIEYYIVENWVNYNPASGATNYGTVNIDGSTYQLGRSQRVNQPSIEGTATFYQYWSVRQNKRTSGTINIGAHFDAWAAVGLNLGTHDYQIMATEGYQSSGQSNITVSEGSSGSTTSSTSSSSSSTSSSSSSSSSSGGGTGSCAGVNVYPNWTARDWSGGAYNHANAGDQMVYQNNLYRANWYTNSTPGSDASWTSLGSCSGGGSTSSTTSSSSSSSTSASSSSNSSSSSSSSSSSGGCREMCNWYGQGMYPLCQNTSGWGWENNQNCIGRQTCQSQNGGSGGVVNSCGTSSSSSSSTSSSSSSSSSSGTTSSSSGIPAARGIH

SEQ ID NO: 179 - DNA, 852 bp, Unknown
  Obtained from an environmental sample
atgaagaattggccgggaacgggtattatattattattggcgggcggccttttggcggcttgtttgacgggcaaacggcaagaggggcaaaaagtggatccggatactcaaaacgagaaattgacaggcgggaccgtgtttacagctaacagcagggggaacaggcccctggaaggttcgccttatggttacgaaatgtggacgcagggcgggaataataacaagcttgtttggttcgggccggatcaggggggaggggcggctttcagggcagaatggaacgagccggatgattttttgggacgactgggtttctggtggggaaacggcgggcaatttaaagaatataaaaatatgtacgcggatttcaattacacaaggtcggggcgcggcaccggcggcagttattcttatataggcatttacggctgggcgagaaacccgaacgccgcgaacgaggaagacaggttaatagaatactatattgtggacgactggttcgggaatcaatggcagtccgacgacacccccattaccacaagaacaacaggaggctccgtattgggtaccattatagcggacggcgcgttttacaacgtcgtcaggaatgtgagaacccaaaagccttcgatagacggcatcaaaacattcgcccaatacttcagcatacgccaaacaccgcgccaaagcgggacaatctccatcaccgaacatttcaaacaatgggaaagcatgggcctgaagctcggaaatatgtacgaggcaaaattcctggtagaagccggcggcggcaccggctggctggagtttacgtatcttaaactgacgcaggaagaaaaaaaaagaaattag

SEQ ID NO: 180 - protein, 283 aa, Unknown
  Obtained from an environmental sample
  SIGNAL (1)...(19)
MKNWPGTGIILLLAGGLLAACLTGKRQEGQKVDPDTQNEKLTGGTVFTANSRGNRPLEGSPYGYEMWTQGGNNNKLVWFGPDQGGGAAFRAEWNEPDDFLGRLGFWWGNGGQFKEYKNMYADFNYTRSGRGTGGSYSYIGIYGWARNPNAANEEDRLIEYYIVDDWFGNQWQSDDTPITTRTTGGSVLGTIIADGAFYNVVRNVRTQKPSIDGIKTFAQYFSIRQTPRQSGTISITEHFKQWESMGLKLGNMYEAKFLVEAGGGTGWLEFTYLKLTQEEKKRN

SEQ ID NO: 181 - DNA, 1077 bp, Unknown
  Obtained from an environmental sample
atgaacttcagtctcaggaaggctgcagcggcgctggcttgcgtcgcgggcctgtatgcatcatcggcgggcgctcagacctgcctgaccaacaaccagaccggcaacaacggcgggtactactactcgttctggaaggacagcggcaacgtcaccttctgcctgcagtccggcgggcgatacacgtcccagtggagcaacgtcaacaactgggtgggcggcaagggctggaacccgggtgggcgacgcaccgtcacctattccggcacctacaaccccaatggcaattcgtacctgaccctgtacggctggaccacgaatccactggtcgagtactacatcgtcgacagctggggttcctggcgcccaccgggctcgggatacatgggcacggtcaccagcgatggcggcacctacgacatctatcgcacgcagcgtgtgaaccagccttccatcatcggcaccgcgacgttctaccaatactggagcgtgcggcaatcgaagcgcgtgggtggcaccatcacctcgggcaatcacttcgatgcctgggcctcgctgggcatgaacctcggcacgcacaactacatggtgatggccaccgagggctaccagagcagcggcagctcggacatcacggtgggcagcggcagttcgtcgtcgagcagcagctcgtccagcagtagcagctcgtcgtccagtagcagcagcagttcttcgtccagcagcagcggtggcggcggcaccaagagcttcaccgtgcgcgcacgcggcacggcgggtggcgagtccatcaccttgcgggtgaacaaccagaacgtgcagacctggacgctgggcaccagcatgcagaactacacggcgtccacctcgctgagcggcggcatcacggtggccttcaccaacgacggcggcaaccgcgacgtccaggtggattacatcatcgtgaatggccagacgcgccagtccgaggcgcagacctacaacaccggcctgtatgccaatggccgctgcggtggtggctctaacagcgagtggatgcactgcaacggcgccatcggctacggcaacacgccctag

SEQ ID NO: 182 - protein, 358 aa, Unknown
  Obtained from an environmental sample
  SIGNAL (1)...(25)
MNFSLRKAAAALACVAGLYASSAGAQTCLTNNQTGNNGGYYYSFWKDSGNVTFCLQSGGRYTSQWSNVNNWVGGKGWNPGGRRTVTYSGTYNPNGNSYLTLYGWTTNPLVEYYIVDSWGSWRPPGSGYMGTVTSDGGTYDIYRTQRVNQPSIIGTATFYQYWSVRQSKRVGGTITSGNHFDAWASLGMNLGTHNYMVMATEGYQSSGSSDITVGSGSSSSSSSSSSSSSSSSSSSSSSSSSSSGGGGTKSFTVRARGTAGGESITLRVNNQNVQTWTLGTSMQNYTASTSLSGGITVAFTNDGGNRDVQVDYIIVNGQTRQSEAQTYNTGLYANGRCGGGSNSEWMHCNGAIGYGNTP

SEQ ID NO: 183 - DNA, 1083 bp, Unknown
  Obtained from an environmental sample
atgatcgaaggtctcaggagacctgccttcagtggcaggagcatcgtcaaggcattgctctgcgtcgcggccctgtatgcatcggcggcgcaggcgcagacctgtctcagttcgagccagaccggcaccaacaacggcttctactattcgttctggaaggacagcccgggcagcgtgcagttctgcatgtattccggcggccgctacacatccaactggagcggcatcaacaactgggtcggcggcaaggggtggcagaccggcgcctcgcgcgtggtcagctactcgggcacgttcaattcaccgggcaacggctacctggcgctgtacggctggaccaccaatccactggtcgagtactacatcgtcgacaactggggcacctatcgcccgccgggcggcacgggattccagggcacggtgaccagtgacggcggtacctacgacatctaccggaccgagcgcaccaacgcgccctgcatcaccggcaacaactgcaacttctcgcagttctggagcgtgcggcagtcgaagcgcaccggcggcaccatcaccaccggcaatcacttcagcgcctgggcgtcgcacggcatgaacatgggccagcacaactaccagatcatggccaccgagggttaccagagcaacggcagctcggacatcacggtctcggaaggcagcagttcgtcgagcagcagcagttcgtcctcttcgtcgagcagcagctcgtcgagcggcggcggcggcagcaagagcttcacggtgcgcgcccgcggcaccgcgggtggcgagcagatccggctgcgcgtgaacaatacgaccgtgcagacctggacgctgaacaccacgatgacgaactacaccgcttcgaccacgctgagcggcggcatcacggtggagtacttcaacgacagcaccaatcacgacgtgcaggtggactacatcatcgtgaacggcgcgacgcgccagtccgaagcgcagagctacaacaccggcctgtatgccaacggccgttgcggtggcggttccaacagcgaatggatgcattgcaatggcgccatcggctacggcaacactccataa

SEQ ID NO: 184 - protein, 360 aa, Unknown
  Obtained from an environmental sample
  SIGNAL (1)...(32)
MIEGLRRPAFSGRSIVKALLCVAALYASAAQAQTCLSSSQTGTNNGFYYSFWKDSPGSVQFCMYSGGRYTSNWSGINNWVGGKGWQTGASRVVSYSGTFNSPGNGYLALYGWTTNPLVEYYIVDNWGTYRPPGGTGFQGTVTSDGGTYDIYRTERTNAPCITGNNCNFSQFWSVRQSKRTGGTITTGNHFSAWASHGMNMGQHNYQIMATEGYQSNGSSDITVSEGSSSSSSSSSSSSSSSSSSSGGGGSKSFTVRARGTAGGEQIRLRVNNTTVQTWTLNTTMTNYTASTTLSGGITVEYFNDSTNHDVQVDYIIVNGATRQSEAQSYNTGLYANGRCGGGSNSEWMHCNGAIGYGNTP

SEQ ID NO: 185 - DNA, 684 bp, Unknown
  Obtained from an environmental sample
atgaatttgaaaagattgaggctgttgtttgtgatgtgtattggatttgtgctgacactgacggctgtgccagctcatgcggaaacgatttatgataataggatagggacacacagcggatacgattttgaattatggaaggattacggaaatacctcgatgacactcaataacggcggggcatttagtgcaagctggaacaatattggaaatgccttatttcgaaaaggaaagaagtttgattccactaaaactcatcatcaacttggcaacatctccatcaactacaacgcagcctttaacccgggcgggaattcctatttatgtgtctatggctggacacaatctccattagctgaatactacattgttgagtcatggggcacatatcgtccaacaggaacgtataaaggatcattttatgccgatggaggcacatatgacatatatgaaacgctccgtgtcaatcagccttctatcattggagacgctaccttcaaacaatattggagtgtacgtcaaacaaaacgcacaagcggaactgtttccgtcagtgagcattttaaaaaatgggaaagcttaggcatgccaatgggaaaaatgtatgaaacagcattaactgtagaaggctaccgaagcaacggaagtgcgaatgtcatgacgaatcagctgatgattcgataa

SEQ ID NO: 186 - protein, 227 aa, Unknown
  Obtained from an environmental sample
  SIGNAL (1)...(27)
MNLKRLRLLFVMCIGFVLTLTAVPAHAETIYDNRIGTHSGYDFELWKDYGNTSMTLNNGGAFSASWNNIGNALFRKGKKFDSTKTHHQLGNISINYNAAFNPGGNSYLCVYGWTQSPLAEYYIVESWGTYRPTGTYKGSFYADGGTYDIYETLRVNQPSIIGDATFKQYWSVRQTKRTSGTVSVSEHFKKWESLGMPMGKMYETALTVEGYRSNGSANVMTNQLMIR

SEQ ID NO: 187 - DNA, 642 bp, Unknown
  Obtained from an environmental sample
atgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaattttgttgttggtaaaggttggactacaggttcgccatttaggacgataaactataatgccggagtttgggcgccgaatggcaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccagtcgaagagaccaaccggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtggtaa

SEQ ID NO: 188 - protein, 213 aa, Unknown
  Obtained from an environmental sample
  SIGNAL (1)...(28)
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQSKRPTGSNATITFSNHVNAWKSHGMNLGSNWAYQVMATEGYQSSGSSNVTVW

SEQ ID NO: 189 - DNA, 570 bp, Unknown
  Obtained from an environmental sample
atggcccttatggcttcgacagactactggcaaaattggactgatggtggtgggacagtaaatgctaccaatggatctgatggcaattacagcgtttcatggtcaaattgcgggaattttgttgttggtaaaggctggactaccggatcagcaactagggtaataaactataatgccggagccttttcgccgtccggtaatggatatttggctctttatgggtggacgagaaattcactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 190 - protein, 189 aa, Unknown
  Obtained from an environmental sample
MALMASTDYWQNWTDGGGTVNATNGSDGNYSVSWSNCGNFVVGKGWTTGSATRVINYNAGAFSPSGNGYLALYGWTRNSLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 191 - DNA, 1053 bp, Unknown
  Obtained from an environmental sample
atgaagtccattcgcagccgcagcctcgccaccgccgtcctggctggcgccctcggcgtcgcagccgccggcgcgcaggcgcagacgctcaacaacaattccaccggcacgcacgacggcttctactacacgttctggaaggactcgggcagcgcctcgatgaccctccatccgggcggacgctacagctcccagtggaccagcaacaccaacaactgggtcggcgggaaaggctggaatcccggtggcccgcgcgtggtcaactactcgggctactacggggtcaacaacagccagaactcctacctggcgctgtacggctggacccgcaatccgctggtcgagtactacgtgatcgagagctacggctcctacaacccggccagttgcgccggcggggtggactacggcagcttccagagcgatggcgccacctacaacgtacgccgctgcctgcgccagaacgcgccgtcgatcgaaggcaacaacagcaccttctaccagtacttcagcgtgcgcaatcccaagaagggattcggcaacatctccggcacgatcaccgtcgccaaccacttcaactactgggccagccgcggcctcaacctcggcaaccacgactacatggtgttcgccaccgagggctaccagagccagggcagcagcgacatcaccgtgagttcgggtaccggcggcggcggtggcggcggcaacacgggcagcaagaccatcgtggtgcgcgcgcgcggcaccgccggcggagagaacatctcgctcaaggtcaacaacgccaccatcgccagctggacgctcaccaccagcatggccaactacacggccaccacctcggcatcgggcggctcgctggtggagttcaccaacgacggcggcaaccgcgacgtgcaggtggactacctcagcgtcaatggcgccgtccgccaggccgaggaccagacctacaacaccggcgtgtaccagaacggccagtgcggcggcggcaacggccgcagcgaatggctgcactgcaacggtgccatcggcttcggaaatctctga

SEQ ID NO: 192 - protein, 350 aa, Unknown
  Obtained from an environmental sample
  SIGNAL (1)...(27)
MKSIRSRSLATAVLAGALGVAAAGAQAQTLNNNSTGTHDGFYYTFWKDSGSASMTLHPGGRYSSQWTSNTNNWVGGKGWNPGGPRVVNYSGYYGVNNSQNSYLALYGWTRNPLVEYYVIESYGSYNPASCAGGVDYGSFQSDGATYNVRRCLRQNAPSIEGNNSTFYQYFSVRNPKKGFGNISGTITVANHFNYWASRGLNLGNHDYMVFATEGYQSQGSSDITVSSGTGGGGGGGNTGSKTIVVRARGTAGGENISLKVNNATIASWTLTTSMANYTATTSASGGSLVEFTNDGGNRDVQVDYLSVNGAVRQAEDQTYNTGVYQNGQCGGGNGRSEWLHCNGAIGFGNL

SEQ ID NO: 193 - DNA, 840 bp, Unknown
  Obtained from an environmental sample
atgacgaagtatcggttaggaataggtattttcattttgttggtttgttgcttttcggcggcatgtattgtgcctaaacaacaagaggaacaaaaagtggctcctacagaattgaccggcgcgataacattcacagccaacagcaacggaaacaagcccctgaacggctcgccctacggttacgaaatatggacacagggcgggaccaataacaaactgatctggttcgggccggatcagggcggcggcgcggctttcagagccgaatggaacaaccctaacgattttttaggccgcgtgggtttttactggggtaatggcggaaaatataccgagtacaaaaatatgtatgcggattttagctacactagatctggacgcaacaccgccggtaattattcatatatagggatttatggctgggctagaaatccaaatgccgcaaaagaagaagacaaattgatagagtattatattgtggaagattggtttggcaatcaatggcaagaggatagctcacccattaccactaatacaacaagtggaaccgtattgggaagttttactatagatggcgcggtttataatgtcgttagaaatgtcagagtccaacaaccttcgatagacggaaccaaaacattcacccaatacttcagcatacgacaaacgccccgacagagcgggacaatttccattaccgggcatttcaggcaatgggagagcatgggtttacagcttggcaatatgtacgaggcaaagtttcttgttgaagccggcggcggcacaggatggctggaattttcataccttaaattaacgatggaagacagcttaaggtaa

SEQ ID NO: 194 - protein, 279 aa, Unknown
  Obtained from an environmental sample
  SIGNAL (1)...(21)
MTKYRLGIGIFILLVCCFSAACIVPKQQEEQKVAPTELTGAITFTANSNGNKPLNGSPYGYEIWTQGGTNNKLIWFGPDQGGGAAFRAEWNNPNDFLGRVGFYWGNGGKYTEYKNMYADFSYTRSGRNTAGNYSYIGIYGWARNPNAAKEEDKLIEYYIVEDWFGNQWQEDSSPITTNTTSGTVLGSFTIDGAVYNVVRNVRVQQPSIDGTKTFTQYFSIRQTPRQSGTISITGHFRQWESMGLQLGNMYEAKFLVEAGGGTGWLEFSYLKLTMEDSLR

SEQ ID NO: 195 - DNA, 1044 bp, Unknown
  Obtained from an environmental sample
atgttcaatctgaagagagtggcggcgctcctgtgcgtcgcagggctgggggtgtctgcggcaaatgcgcagacctgtctcaattcgagtgggaccggcaccaacaacggcttctattattccttctggaaagacagtccgggttcagtgaatttctgcatgtactccggcggtcgctacacgtcgagctggagcggcatcaacaactgggtcggcggcaagggctggcaaaccggatcgcgccggaccatcaactactccggcagcttcaactcgccgggcaatggctacctcgcgctctacggatggaccaccaatccactcgtcgagtactacatcgtcgacaactggggcacgtatcgtccgcccggcggccagggctacatgggcacggtcacgagcgacggcgccacgtacgacgtctatcgaacgcaacgagtcgatgcgccgtcgatcattggtgatcaccagaccttctatcaatactggagcgtgcgtcagtcgaagaggaccggcggaaccatcaccaccggcaaccacttcgatggctgggcgagctacggcatgaacctgggaactcacaactaccagatcctggcgaccgagggttatcaaagcagcggcagctcggacctcaccgtgagcgaaggcagcagcagtagcagcagcggtggcgggagcagttcgagcagcagcggcggcggtggcaccaagagcttcacggtccgcgcgcgcggcacggccggtggagagtcgatcacgttgcgcgtgaataaccagaacgtgcagacctggacgctcggcacgagcatgacgaactacacggcgtcgacgtcgctgagcggcggcatcaccgtggcgttcacgaacgacggtggcaaccgcgatgttcaggtggactacatcatcgtgaacggccagacacgccagtcggaagcgcagagctacaacaccgggctctacgcgaatggacgttgcggcggtggctcgaacagcgagtggatgcactgcaacggcgcgattggctacggaaacacgccgtaa

SEQ ID NO: 196 - protein, 347 aa, Unknown
  Obtained from an environmental sample
  SIGNAL (1)...(23)
MFNLKRVAALLCVAGLGVSAANAQTCLNSSGTGTNNGFYYSFWKDSPGSVNFCMYSGGRYTSSWSGINNWVGGKGWQTGSRRTINYSGSFNSPGNGYLALYGWTTNPLVEYYIVDNWGTYRPPGGQGYMGTVTSDGATYDVYRTQRVDAPSIIGDHQTFYQYWSVRQSKRTGGTITTGNHFDGWASYGMNLGTHNYQILATEGYQSSGSSDLTVSEGSSSSSSGGGSSSSSSGGGGTKSFTVRARGTAGGESITLRVNNQNVQTWTLGTSMTNYTASTSLSGGITVAFTNDGGNRDVQVDYIIVNGQTRQSEAQSYNTGLYANGRCGGGSNSEWMHCNGAIGYGNTP

SEQ ID NO: 197 - DNA, 636 bp, Unknown
  Obtained from an environmental sample
atgtttaagttcagtaagaaaatgatgacggttattcttgcagctaccatgagttttggtttatttgcaacaacctcaagtgcagcaaccgactattggcaaaattggaccgatggcggcggaacggttaatgctgtaaacggctccggcggtaattacagcgtgacatggcaaaataccggaaattttgtcgtcggcaaaggctggaataccggatcgcctaaccgaaccattaactacaatgccggcgtctgggcgccttccggcaatgggtatttgactctctacggatggacgagaaacgcactcattgaatattacgtcgtggatagctggggtacttatcggcctacaggaacatataaagggacggtgacaagtgatgggggcacatatgatatctatacgaccatgcggcacaacgcgccttccattgacggaactcaaacgtttgcccagtactggagtgttcgacaatcgaaaagagcgaccggggtcaactcctccattacgttcagcaaccacgtgaacgcatgggctagcaagggaatgaatctgggaagcagctggtcatatcaggtgttagctacagagggttatcaaagtagcggaagctctaacgtaacagtgtggtaa

SEQ ID NO: 198 - protein, 211 aa, Unknown
  Obtained from an environmental sample
  SIGNAL (1)...(28)
MFKFSKKMMTVILAATMSFGLFATTSSAATDYWQNWTDGGGTVNAVNGSGGNYSVTWQNTGNFVVGKGWNTGSPNRTINYNAGVWAPSGNGYLTLYGWTRNALIEYYVVDSWGTYRPTGTYKGTVTSDGGTYDIYTTMRHNAPSIDGTQTFAQYWSVRQSKRATGVNSSITFSNHVNAWASKGMNLGSSWSYQVLATEGYQSSGSSNVTVW

SEQ ID NO: 199 - DNA, 1074 bp, Unknown
  Obtained from an environmental sample
atgattttcggtctaaagtcgatcacgggcaggcgcgccgtcgcggcgctggcctgccttgccggcctctacatggcgccggcgaatgcgcaaacctgcatcacgtcgagccagacgggcaccaacaacggcaactacttttcgttctggaaagacagcccgggcacggtgaacttctgcatgtactccggcggccgctacacgtccaactggagcggcatcaacaactgggtgggcggcaagggctggcagacgggctcgtcccgcaccgtctcctactccggcagcttcaattcgccgggtaacggctacctgacgctctacggctggaccaccaatccgctcatcgagtactacatcgtcgacaactggggcagctatcgtccgccgggtggccagggcttcatgggcacggtgaacaccgacggcggcacgtacgacatctatcgcacgcaacgggtcaaccagccgtcgatcatcggcaccgcgacgttctaccagtactggagcgtgcggcagtcgaagcgcaccggcggcaccatcaccacggccaaccacttcaatgcctgggccagcctcggcatgaacctgggacagcacaactaccaggtgatggccaccgagggctaccagagcagcggcagctccgacatcacggtgtgggaaggcacgagcagcggcggaagcagcaatggcggcagcagcaacggcggcagcagcaatggtggcagcggcggcacgaagagcttcacggtgcgcgcgcgcggcactgcgggcggcgagtccatcacgctgcgggtcaacaaccagaacgtgcagacctggacgctgggtaccagcatgcagaactacacggcctcgacctcgctgagcggcggcatcacggtggcgttcaccaacgacggcggcagccgcgacgtgcaggtggactacatcatcgtgaatggccagacccgccagtccgaacagcagagctacaacactggcctctacgccaatggaagctgtggtggcggttcgaacagcgagtggatgcattgcaacggcgccatcggctacggcaatacgccctga

SEQ ID NO: 200 - protein, 354 aa, Unknown
  Obtained from an environmental sample
  SIGNAL (1)...(30)
MIFGLKSITGRRAVAALACLAGLYMAPANAQTCITSSQTGTNNGNYFSFWKDSPGTVNFCMYSGGRYTSNWSGINNWVGGKGWQTGSSRTVSYSGSFNSPGNGYLTLYGWTTNPLIEYYIVDNWGSYRPPGGQGFMGTVNTDGGTYDIYRTQRVNQPSIIGTATFYQYWSVRQSKRTGGTITTANHFNAWASLGMNLGQHNYQVMATEGYQSSGSSDITVWEGTSSGGSSNGGSSNGGSSNGGSGGTKSFTVRARGTAGGESITLRVNNQNVQTWTLGTSMQNYTASTSLSGGITVAFTNDGGSRDVQVDYIIVNGQTRQSEQQSYNTGLYANGSCGGGSNSEWMHCNGAIGYG

SEQ ID NO: 201 - DNA, 1002 bp, Unknown
  Obtained from an environmental sample
atgaagatgaacagctccctcccctccctccgcgatgtattcgcgaatgatttccgcatcggggcggcggtcaatcctgtgacgatcgagatgcaaaaacagttgttgatcgatcatgtcaacagtattacggcagagaaccatatgaagtttgagcatcttcagccggaagaagggaaatttacctttcaggaagcggatcggattgtggattttgcttgttcgcaccgaatggcggttcgagggcacacacttgtatggcacaaccagactccggattgggtgtttcaagatggtcaaggccatttcgtcagtcgggatgtgttgcttgagcggatgaaatgtcacatttcaactgttgtacggcgatacaagggaaaaatatattgttgggatgtcatcaacgaagcggtagccgacgaaggagacgaattgttgaggccgtcgaagtggcgacaaatcatcggggacgattttatggaacaagcatttctctacgcttatgaagctgacccagatgcactgcttttttacaatgactataatgaatgttttccggaaaagagagaaaaaatttttgcacttgtcaaatcgctgcgtgataaaggcattccgattcatggcatcggcatgcaggcgcactggagcctgacccgcccgtcgcttgatgaaattcgtgcggcgattgaacggtatgcgtcccttggtgttgttcttcatattacggaactcgatgtatccatgtttgaatttcacgatcgtcgaaccgatttggctgtcccgacgaacgaaatgatcgaacagcaagcagaacggtatgggcaaatttttgctttgtttaaggagtatcgcgatgttattcaaagtgtcacattttggggaattgctgatgaccatacatggctcgataactttccagtgcacgggagaaaaaactggccgcttttgttcgatgaacagcataaaccgaaaccagctttttggcgggcagtgagtgtctga

SEQ ID NO: 202 - protein, 333 aa, Unknown
  Obtained from an environmental sample
MKMNSSLPSLRDVFANDFRIGAAVNPVTIEMQKQLLIDHVNSITAENHMKFEHLQPEEGKFTFQEADRIVDFACSHRMAVRGHTLVWHNQTPDWVFQDGQGHFVSRDVLLERMKCHISTVVRRYKGKIYCWDVINEAVADEGDELLRPSKWRQIIGDDFMEQAFLYAYEADPDALLFYNDYNECFPEKREKIFALVKSLRDKGIPIHGIGMQAHWSLTRPSLDEIRAAIERYASLGVVLHITELDVSMFEFHDRRTDLAVPTNEMIEQQAERYGQIFALFKEYRDVIQSVTFWGIADDHTWLDNFPVHGRKNWPLLFDEQHKPKPAFWRAVSV

SEQ ID NO: 203 - DNA, 687 bp, Unknown
  Obtained from an environmental sample
atgaaatctgcacgcgcacttttggtggcgctatcacgcatacttccgatcgcacttgtgctgttgctcgcccccgtccccgcgcaagcccaacaggtctgcaacaacggaacgggcacgcataacggcttcttctggacgttttggaaggacggcggcacggcctgcatgacgctcggctcgggcggcaattatagcacgacgttcaatctgtccggcggccgcaaccttgttgcgggcaagggctggcagactggctccaccaaccgagtcgtcggttacaatgcgggcgtctggaacccaggcaccaattcttatctgacgctctatggctggtcgacgaatccgctcgtcgaatattatgtcgtggaccattggggcagccaattcaccccgccaggcaacggcgcgcagagcatggggaccgtgaccaccgacggcggcacctacaacatctaccgcacccaacgcgtcaacgcgccttcgatcatcggcaacgccacgttctaccaatattggagcgtgcgcacttcgcgccgcgggcaaggcacgaacaacacgatcaccttcgccaatcacgtcaacgcttggcgcagccgcggcatgaaccttgggaccatgaattatcaagtcatggccacggaaggtttcggctcgaacggaagctccaacctcacagtatggtag

SEQ ID NO: 204 - protein, 228 aa, Unknown
  Obtained from an environmental sample
  SIGNAL (1)...(30)
MKSARALLVALSRILPIALVLLLAPVPAQAQQVCNNGTGTHNGFFWTFWKDGGTACMTLGSGGNYSTTFNLSGGRNLVAGKGWQTGSTNRVVGYNAGVWNPGTNSYLTLYGWSTNPLVEYYVVDHWGSQFTPPGNGAQSMGTVTTDGGTYNIYRTQRVNAPSIIGNATFYQYWSVRTSRRGQGTNNTITFANHVNAWRSRGMNLGTMNYQVMATEGFGSNGSSNLTVW

SEQ ID NO: 205 - DNA, 1068 bp, Unknown
  Obtained from an environmental sample
atgcaaattttcaaatcaccactgtcatgggccggatcactattactgatcctgtccaccgccctgttttcaacagcggccactgcccaggaatactgctccaaccagaccggtacacacagcggtttttactttacccattggtctgacggcggcggtactgcctgcattactctgggagacgacggaaattacagttacacctggtccaacacaggcaattttgtcggtggcaagggctggagtaccggcacctccaatcgggtgatcggttacaacgccggagactactcgccctccggcaactcctacctggcgctgtatggctggagcaccaatccactgattgagtactacgtggtggatagctggggtagctggcgtccgccgggtggcacctcggtaggtacagtcaccagcgatggcgggacttacgacctgtaccgcaccgagcgcgtgcagcagccctccatcgaaggcacggccaccttctatcaatattggagcgtgcgcacctcacagcgtccccaggggcagaacaacaccatcacctttcagaaccacgtggatgcctgggccaatcagggctggaacctcggcacccacaactatcaggtaatggcgaccgaaggctacgaaagcagcggcagctccaacgtcacggtttgggattccggcaccagtagcggtaacggtggcaacgctggcggcggtggtggcgaggcaggtaacggctccaactcactggtcgtgcgtgcggtgggcacttcgggcaacgaacagttgcgcgtcaacgtcagcggcaacacggttgaaaccctgaacctgtctaccaactggcaggactacaccatcaacaccaacgcttccggcgatgtgaatgtggagttgatcaacgatcagggcgagggctacgaagcccgggtggaatacgtcatcgtcaacggcgatacccgctacggcgctgatcagagctacaacaccagcgcctgggacggcgagtgcggcggcggttcctttaccatgtggatgcactgcgaaggcatcctcggttttggcgatatgtaa

SEQ ID NO: 206 - protein, 355 aa, Unknown
  Obtained from an environmental sample
  SIGNAL (1)...(29)
MQIFKSPLSWAGSLLLILSTALFSTAATAQEYCSNQTGTHSGFYFTHWSDGGGTACITLGDDGNYSYTWSNTGNFVGGKGWSTGTSNRVIGYNAGDYSPSGNSYLALYGWSTNPLIEYYVVDSWGSWRPPGGTSVGTVTSDGGTYDLYRTERVQQPSIEGTATFYQYWSVRTSQRPQGQNNTITFQNHVDAWANQGWNLGTHNYQVMATEGYESSGSSNVTVWDSGTSSGNGGNAGGGGGEAGNGSNSLVVRAVGTSGNEQLRVNVSGNTVETLNLSTNWQDYTINTNASGDVNVELINDQGEGYEARVEYVIVNGDTRYGADQSYNTSAWDGECGGGSFTMWMHCEGILGFGDM

SEQ ID NO: 207 - DNA, 633 bp, Unknown
  Obtained from an environmental sample
atgaaattaaaaaagaagatgctcactttactcctgacggcttcgatgagtttcggtttatttggggcaacctcgagtgcagcaacggattattggcaatattggacggatggcggcggaacggtgaatgcggttaacgggtccgggggcaattacagcgtaacttggcaaaatagcgggaacttcgtggtcggcaaaggctggagcgtagggtcgccaaatcggacgatcaattacaatgccggcatctgggaaccttcggggaacgggtacttgaccctttacggatggactagaaactcgctgatcgagtattacgttgtcgacagttgggggacgtaccggccaacaggtactcacaaaggaacggtgaacagcgacggaggcacctacgatatttatacgaccatgcgctataatgcgccttccattgatggcacgcagacgttccaacagttctggagcgtgcggcaatcgaaacgaccaaccggcagcaacgtctccatcaccttcagcaatcacgtgaatgcctggagaagcaagggcatgaacctgggcagcagctggtcgtaccaggtcttggcgacggaaggctatcagagcagcggaagatccaacgtcacggtgtggtaa

SEQ ID NO: 208 - protein, 210 aa, Unknown
  Obtained from an environmental sample
  SIGNAL (1)...(27)
MKLKKKMLTLLLTASMSFGLFGATSSAATDYWQYWTDGGGTVNAVNGSGGNYSVTWQNSGNFVVGKGWSVGSPNRTINYNAGIWEPSGNGYLTLYGWTRNSLIEYYVVDSWGTYRPTGTHKGTVNSDGGTYDIYTTMRYNAPSIDGTQTFQQFWSVRQSKRPTGSNVSITFSNHVNAWRSKGMNLGSSWSYQVLATEGYQSSGRSNVTVW

SEQ ID NO: 209 - DNA, 1194 bp, Unknown
  Obtained from an environmental sample
atgaaaacatttagtgtgaccaagtctagcgttgttttcgcaatggctttgggtatggcttcgacagcttttgctcaggatttctgcagcaatgcgcaacattccggccaaaaggtaacgattacttcgaaccaaactggtaaaatcggcgatatcggttacgaactctgggacgaaaacggtcatggtggtagtgctaccttctatagcgatggttccatggactgcaatatcactggtgctaaggactatctctgccgtgcgggcctttccctcggcagtaacaagacctacaaggaacttggtggtgatatgattgccgagttcaagcttgtgaagagcggtgcccagaatgtgggttactcttatatcggtatctatggctggatggaaggtgtttctggaacgcctagccagttggtcgaatactacgtgattgataacaccctcgccaatgacatgccgggtagctggattggtaacgaaagaaagggtaccattacggttgacggcggtacctatactgtttatcgcaatacccgtacaggtccggctattaagaacagcggtaacgtcacgttctatcagtatttcagcgttcgtacctctccgcgcgattgcggtaccatcaatatttccgaacacatgagacagtgggaaaagatgggcatgaccatgggtaagctctacgaagccaaggtgcttggcgaagcgggtaacgtgaatggcgaagtccgcggtggtcacatggacttcccgcatgctaaggtttatgtgaaaaacggctctgatccggcttcttcctcttctgtgaagtccagctcttctacagtaacgccaaaatccagctcctcgaagggtaacggcaacgtttctggtaaaattgacgcctgcaaggacgctatgggccatgaaggcaaagaaacgagaactcagggtcagaacaactctagcgtgacgggtaacgtcggcagctctccgtaccactatgaaatttggtatcagggtggtaacaactccatgacgttctacgacaacggtacttataaggcaagctggaatggtaccaacgacttccttgctcgtgtcggtttcaagtatgatgaaaagcacacttacgaagaacttggccctatcgatgcctactacaagtggagcaagcagggtagtgctggtggctacaactacatcggt

SEQ ID NO: 210 - protein, 398 aa, Unknown
  Obtained from an environmental sample
  SIGNAL (1)...(25)
MKTFSVTKSSVVFAMALGMASTAFAQDFCSNAQHSGQKVTITSNQTGKIGDIGYELWDENGHGGSATFYSDGSMDCNITGAKDYLCRAGLSLGSNKTYKELGGDMIAEFKLVKSGAQNVGYSYIGIYGWMEGVSGTPSQLVEYYVIDNTLANDMPGSWIGNERKGTITVDGGTYTVYRNTRTGPAIKNSGNVTFYQYFSVRTSPRDCGTINISEHMRQWEKMGMTMGKLYEAKVLGEAGNVNGEVRGGHMDFPHAKVYVKNGSDPASSSSVKSSSSTVTPKSSSSKGNGNVSGKIDACKDAMGHEGKETRTQGQNNSSVTGNVGSSPYHYEIWYQGGNNSMTFYDNGTYKASWNGTNDFLARVGFKYDEKHTYEELGPIDAYYKWSKQGSAGGYNYIG

SEQ ID NO: 211 - DNA, 1086 bp, Unknown
  Obtained from an environmental sample
atgataagttctaaagcatcacagtcatggggctggtcactattggtggccctgtccgccgttctgctttcggcgacagcttccgcccagcaacactgctccaaccaaaccggtacgcacaacggtttttactttacccattggtcagacggtggcggtaccgcctgcatgactctgggggacgacggcaactacagctatacctggtccaacactggcaattttgtcggtggtaagggctggagcacaggtacatccaaccgggtgattggttacaacgccggagactactcgccctccggcaactcctacctggcactgtatggctggagcaccaatccgctgattgaatattacgtggtcgacagttggggcagctggcgtccgccgggtggcacctctgtgggcacggtaaccagcgacggtggcacttacgacctgtaccgaacccagcgtgtgcagcagccctccattgagggtacggccaccttctatcaatactggagcgtgcgcacctcacagcggcctcaggggcaaaacaacaccatcacctttcagaaccacgtgaatgcctgggccaatcagggctggaatctgggcacccacaactatcaggtgatggcgaccgaaggctacgaaagcagcggcagctccaacgtcaccgtttgggattccggcaccagtagcggtggcggtggcggtggcaacgcgggcggcggcggagcccccggtggtggtgaggctggaggcggctccaactcactggttgtgcgtgcggtgggcacttcgggcaatgaacagttgcgcgtcaacgtcagtggcaacacggtggaaaccctgaacctgtctaccaactggcaggactacaccatcaacaccaacgcctccggcgatgtcaatgtggaattgatcaacgaccagggcgaaggctacgaggcccgcgtcgagtacgtcatcatcaacggcgatacccgctacggcgccgaccagagctacaacaccagcgcctgggacggcgagtgcggtagcggttcctttaccatgtggatgcactgcgaaggcatcctcggttttggcgatatgtaa

SEQ ID NO: 212 - protein, 361 aa, Unknown
  Obtained from an environmental sample
  SIGNAL (1)...(29)
MISSKASQSWGWSLLVALSAVLLSATASAQQHCSNQTGTHNGFYFTHWSDGGGTACMTLGDDGNYSYTWSNTGNFVGGKGWSTGTSNRVIGYNAGDYSPSGNSYLALYGWSTNPLIEYYVVDSWGSWRPPGGTSVGTVTSDGGTYDLYRTQRVQQPSIEGTATFYQYWSVRTSQRPQGQNNTITFQNHVNAWANQGWNLGTHNYQVMATEGYESSGSSNVTVWDSGTSSGGGGGGNAGGGGAPGGGEAGGGSNSLVVRAVGTSGNEQLRVNVSGNTVETLNLSTNWQDYTINTNASGDVNVELINDQGEGYEARVEYVIINGDTRYGADQSYNTSAWDGECGSGSFTMWMHCEGILGFGDM

SEQ ID NO: 213 - DNA, 912 bp, Unknown
  Obtained from an environmental sample
gtgaacgcacaacaaacccttacgtctaactccaccggtactcatggtggtcactactattctttctggaaggactccggcaatgcgtccttcactctctacgatggcggacgttacggctcgcaatggaatagcggcaccaacaattgggtgggcggtaaaggctggaacccgggcggcgcaaaagtcgttaactacgaaggttattacggcgttaacaattcccagaattcttacctggcactctacgggtggacccgcaatccgctgatcgagtactacataatcgaaagttacggttcgtacaacccatcgagctgtagtggcggtactaactacggtagcttccaaagcgatggtgcgacctataacgtccgccgttgccagcgcgtacagcagccatcgattgatggaacgcaaacgttctatcagtatttcagcgttcgctcacccaaaaagggcttcggccaaatcagcggcactatcaatgtaggcaaccactttaattattgggccagcaaagggctgaatttgggtagccacgattacatggttctggcgactgaaggctatcagagcagcggcaattcagatatttccgtgtccgaaggcagcagcggcggctcttcctcaggcggttcgacctccagcggaagctcctccggtagtacgaccagttcttcaggaggcggtggcggcggcatcacagtacgtgctcgcggcactaatggtgatgagcgtatcagcctgcgtgtcggcggttctgcggtagccagttggacactcagtaccagcgcacaaagctatagctacacaggcggcgcctctggcgatatccaggtggaattcgatatcaagcttatcgataccgtcgacctcgagggggggcccggtacccaattcgccctatag

SEQ ID NO: 214 - protein, 303 aa, Unknown
  Obtained from an environmental sample
VNAQQTLTSNSTGTHGGHYYSFWKDSGNASFTLYDGGRYGSQWNSGTNNWVGGKGWNPGGAKVVNYEGYYGVNNSQNSYLALYGWTRNPLIEYYIIESYGSYNPSSCSGGTNYGSFQSDGATYNVRRCQRVQQPSIDGTQTFYQYFSVRSPKKGFGQISGTINVGNHFNYWASKGLNLGSHDYMVLATEGYQSSGNSDISVSEGSSGGSSSGGSTSSGSSSGSTTSSSGGGGGGITVRARGTNGDERISLRVGGSAVASWTLSTSAQSYSYTGGASGDIQVEFDIKLIDTVDLEGGPGTQFAL

SEQ ID NO: 215 - DNA, 1065 bp, Unknown
  Obtained from an environmental sample
atgtttgcaagattcgagaaactggccgcggcgggtaaagccgtcgtggccctggcagggctcgcccttttgggcacggcgcctgccaatgcacagacctgtctcacgaacaattccaccggcaccaacaacggctactactactcgttctggaaggacagcggcaacgtgaccttctgcatgtacgggggcggccgctatacctcgcagtggagcaacatcaacaactgggtgggcggcaagggctggaatccgggcggtcgtcggaccgtcacctattcggggacgttcaacccgaacggcaattcctatctcacgctgtacggctggaccaccaatccactggtcgagtactacatcgtcgacagctggggcagctggcgtccgccgggttccggctacatgggttccgtcacgagcgacggcggcacctacgacatctatcgcacgcagcgcgtcaaccagccctcgatcatcggcaccgcgacgttctaccagtactggagcgtgcggcagcagaagcgcgtgggtggcaccatcaccaccggcaaccacttcgatgcctgggcttcgctgggcatgaacctcggccagcacaactacatggtcatggccaccgagggctaccagagcagcggcagctccgacatcacggtgggcggcaccagcagctcctcgtcgtcgagcgggggcagcagcagcagtagcagcagcagcgggggtggcggctcgaagagcttcaccgtgcgcgcgcggggttcgacgggcggtgagcagatcagtttgcgcgtgaacaaccagaccgtgcagaactggacgctgggcaccagcatgcagaactacaccgcgtccaccaacctgagcggcggcatcaccgtgcacttcaccaatgacagcggcaaccgcgacgtgcaggtggactacatccaggtgaacggccagacgcgtcaatccgagcagcagagctacaacaccgggctgtatgccaacggcagctgtggcggcggcggctacagcgagtggatgcattgcaatggcgcgatcggttacggcaacacgccgtag

SEQ ID NO: 216 - protein, 354 aa, Unknown
  Obtained from an environmental sample
  SIGNAL (1)...(31)
MFARFEKLAAAGKAVVALAGLALLGTAPANAQTCLTNNSTGTNNGYYYSFWKDSGNVTFCMYGGGRYTSQWSNINNWVGGKGWNPGGRRTVTYSGTFNPNGNSYLTLYGWTTNPLVEYYIVDSWGSWRPPGSGYMGSVTSDGGTYDIYRTQRVNQPSIIGTATFYQYWSVRQQKRVGGTITTGNHFDAWASLGMNLGQHNYMVMATEGYQSSGSSDITVGGTSSSSSSSGGSSSSSSSSGGGGSKSFTVRARGSTGGEQISLRVNNQTVQNWTLGTSMQNYTASTNLSGGITVHFTNDSGNRDVQVDYIQVNGQTRQSEQQSYNTGLYANGSCGGGGYSEWMHCNGAIGYGNTP

SEQ ID NO: 217 - DNA, 1083 bp, Unknown
  Obtained from an environmental sample
atgactttcgtcaagacgatcaccggcagacgcgccatcgcggcgttcctctgcctcgccggcctctacatggcgccggcaaacgcgcaaacctgcatcacgtccagccagaccggcaccaacaacgggaactacttttcgttctggaaagacagcccgggcacggtgaacttctgcatgtacccgaatggccgctacacctcgaactggagcggcatcaacaactgggtcggcggcaagggctggtcgaccggctccagccgcaccgtcagctattcgggcagcttcaattcgcccggcaacggctacctgactctctacgggtggaccaccaacccgctcatcgagtactacatcgtcgagaactggggtaactaccgcccgccgggcggccaggggtacatggggaccgtcaattccgacggggcgacctatgacatctaccggaccttccgggacaaccagccctgcatcacgggcaactcctgcgacttctaccagtactggagcgtgcgccagtccaagcgcagcagcggcaccatcaccacggccaatcacttcgcggcgtggaacagcctcggcatgaacctgggccagcacaactaccaggtcatggccaccgagggttaccagagcagcggcagctccgacatcacggtcacggaaggcggcggcggcagcagcaatggtggcagcagcaacggcggcagcagcaatggcggcagcagcaatggcggcggcggcggcaccaagagcttcacggtccgcgcccgtggcaccgcgggtggcgagtccatcacgctgcgtgtcaacaaccagaacgtgcagacctggacgctgggcaccggcatgcagaactacacggcctcgacctcgctgagcggtggcatcacggtgcacttcaccaacgacggcggaagccgcgacgtgcaggtggactacatccaggtgaacggcagcacgcgccagtccgaggcacagagctacaacaccggcgcctacctgaacggccgttgcggcggtggcggcaacagcgaatggatgcattgcaacggcgccatcggctacggcaatacgccctga

SEQ ID NO: 218 - protein, 360 aa, Unknown
  Obtained from an environmental sample
  SIGNAL (1)...(29)
MTFVKTITGRRAIAAFLCLAGLYMAPANAQTCITSSQTGTNNGNYFSFWKDSPGTVNFCMYPNGRYTSNWSGINNWVGGKGWSTGSSRTVSYSGSFNSPGNGYLTLYGWTTNPLIEYYIVENWGNYRPPGGQGYMGTVNSDGATYDIYRTFRDNQPCITGNSCDFYQYWSVRQSKRSSGTITTANHFAAWNSLGMNLGQHNYQVMATEGYQSSGSSDITVTEGGGGSSNGGSSNGGSSNGGSSNGGGGGTKSFTVRARGTAGGESITLRVNNQNVQTWTLGTGMQNYTASTSLSGGITVHFTNDGGSRDVQVDYIQVNGSTRQSEAQSYNTGAYLNGRCGGGGNSEWMHCNGAIGYGNTP

SEQ ID NO: 219 - DNA, 1029 bp, Unknown
  Obtained from an environmental sample
atgacatcaggtctcaagaaagtgatggcattcgtctgtctcgccacccttggcgtttcggcgcatgcccagacatgtattcagtccagtcagaccggcaccaacaacggattctatttctccttctggaaggacaacccgggcacggtgcagttctgcctgcagagcggcggtcgttacacctccaactggaacggcatcaacaactgggtgggcggcaaggggtggcagaccggcgcacgccgcacggtgaactactcgggctcgttcaactcgccgggcaacggctatctggcgctgtacggctggaccaccaatccgctggtcgagtactacatcgtcgacagctggggcagcttccgtccgccgggcaacactgcaggcctgtgggtactggtgaacagcgatggcggcacctacgacatctatcgcgcgcatcgcagtaacgcgccctgcatcaccggcagcagctgcgacttcgaccagtactggagcgtgcgacagtcgaagcgcgtcggcggcaccatcaccaccggcaaccacttcgatgcctgggcgaaccaccagatgaatctgggccagttcaactaccagatcatggctaccgagggtttccagagcaacggcagctccgacatcaccgtcagtgaatgcaccagcaattgcggcggtggcggcggcggcgggggtggcagcaacagcatcacggtgcgcgcgcgcggcacgggcggcggcgagcagatccggctgcgggtgaacaacaccacggtgcaaacctggacgctgaccaccagctaccagaacttcacggcttcgacctcgctgagcggcggcaccatcgtcgagtacttcaacgacagttccggccatgacgtgcaggtcgactacatcatcgtgaatggcgtgacccgccagtccgaatcgcagagctacaacaccgggctgtatgccaacgggcgttgcggcggcggctccaacagcgagtggatgcattgcaacggtgccattggatacggaaataccccgtaa

SEQ ID NO: 220 - protein, 342 aa, Unknown
  Obtained from an environmental sample
  SIGNAL (1)...(23)
MTSGLKKVMAFVCLATLGVSAHAQTCIQSSQTGTNNGFYFSFWKDNPGTVQFCLQSGGRYTSNWNGINNWVGGKGWQTGARRTVNYSGSFNSPGNGYLALYGWTTNPLVEYYIVDSWGSFRPPGNTAGLWVLVNSDGGTYDIYRAHRSNAPCITGSSCDFDQYWSVRQSKRVGGTITTGNHFDAWANHQMNLGQFNYQIMATEGFQSNGSSDITVSECTSNCGGGGGGGGGSNSITVRARGTGGGEQIRLRVNNTTVQTWTLTTSYQNFTASTSLSGGTIVEYFNDSSGHDVQVDYIIVNGVTRQSESQSYNTGLYANGRCGGGSNSEWMHCNGAIGYGNTP

SEQ ID NO: 221 - DNA, 1044 bp, Unknown
  Obtained from an environmental sample
atgattgttagtttcaagagcgtgaaggcactcgcgtgcctggccgtgctcggcgtgaccgccgcgcaggcgcaaacctgcatcaattccagccagaccggcaccaacaacggcaattatttttcattctggaaagacaacccgggcacggtgaccttctgcatgtatgccaacggccgctacacctccaactggagcggcatcaacaactgggtgggtggcaagggctggcagaccggctcgaatcgcacggtgacctactccggttcgttcaactcgcccggcaacggctacctcaccctgtacgggtggaccacgaatccgctgatcgagtactacatcgtcgacagttggggcagttatcgaccgcccggcggccagggcttcatgggcaccgtgacgaccgacggcggcacctacgacatctatcgcacgcagcgcgtgaaccagccttccatcatcggcaccgcgacgttctaccagtactggagcgtgcggcagtcgaagcgcgtggggggcaccatcaccaccgccaaccacttcaatgcctgggcgacgctgggcatgaacctgggccagcacaactaccaggtcatggccaccgagggttaccagagcagcggcagctccgacatcaccgtgaccgaaggcggcggcagctcgtcgtcgtcgagcggcggcggcagcaccagcagcggcggtggcggcagcaagagcttcacggtgcgcgcccgcggcacggtcggcggcgaaaacatccagctgcaggtcaacaaccagacggtggcgagctggaacctgaccaccagcatgcagaactacaacgcctcgaccagcctgagtggcggcatcaccgtggtctacaccaacgacggcggtaaccgcgacgtccaggtcgactacatcaccgtgaacggccagacccgccagtccgaagcgcagagtttcaacaccgggctgtatgccaacggacgttgtggcggcggctcgaacagcgagtggatgcattgcaatggcgcgatcggctacggcaacacgccgtaa

SEQ ID NO: 222 - protein, 347 aa, Unknown
  Obtained from an environmental sample
  SIGNAL (1)...(24)
MIVSFKSVKALACLAVLGVTAAQAQTCINSSQTGTNNGNYFSFWKDNPGTVTFCMYANGRYTSNWSGINNWVGGKGWQTGSNRTVTYSGSFNSPGNGYLTLYGWTTNPLIEYYIVDSWGSYRPPGGQGFMGTVTTDGGTYDIYRTQRVNQPSIIGTATFYQYWSVRQSKRVGGTITTANHFNAWATLGMNLGQHNYQVMATEGYQSSGSSDITVTEGGGSSSSSSGGGSTSSGGGGSKSFTVRARGTVGGENIQLQVNNQTVASWNLTTSMQNYNASTSLSGGITVVYTNDGGNRDVQVDYITVNGQTRQSEAQSFNTGLYANGRCGGGSNSEWMHCNGAIGYGNTP

SEQ ID NO: 223 - DNA, 642 bp, Unknown
  Obtained from an environmental sample
atgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaatttcgttgttggtaaaggttggactacaggttcgccatttaggacgataaactataatgccggagtttgggcaccgaatggaaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccaaacgaagagaccaaccggaagcaacgctacaatcactttcagcaatcatgttaacgcatggaagagccatggaatgaatctgggcagtaattgggcttaccaagtcatggcgacagaaggatatcaaagtagtggaagttctaacgtaacagtgtggtaa

SEQ ID NO: 224 - protein, 213 aa, Unknown
  Obtained from an environmental sample
  SIGNAL (1)...(28)
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQTKRPTGSNATITFSNHVNAWKSHGMNLGSNWAYQVMATEGYQSSGSSNVTVW

SEQ ID NO: 225 - DNA, 1059 bp, Unknown
  Obtained from an environmental sample
atgtttgttagtctcaggaagacggcttgggcgtgcctgttgctcgccggcctcggaatctcgacttcacaagcccagacctgcatcacgtccagcgggacgggcaccaacaacggccactactattccttctggaaggacagtggcggcaccgtcaacttctgcatgtacgcgaacggccgctacacctccaactggagcggcatcaacaactgggtgggcggcaagggctggcagaccggctcacgccggacgatcagctactcgggctcgttcaactcacccggcaatggttatctcaccctgtacggttggaccaccaatccattgatcgagtactacatcgtcgacaactggggcacgtaccggccgccgggaggctcgggctacatgggcacggtgacgagcgacggcggcacctacgacgtctatcgcacccagcgcgtaaaccagccttccatcatcggcaccgcgacgttctatcaatactggagcgtgcgccagcagaagcggaccggcgggaccatcaccaccggcaatcacttcgacgcctgggccgcatacggaatgaacctcggcacccacaactaccagatcatggcgaccgagggttaccagagcagcggcagttcggacatcacggtgagcgagggcggtggcagttcatcgagcagcagctcgtcgagcagcagcagttcgtcctcttcgagcggcggcggcggcacgaagagcttcacggtccgcgcgcgcggcacggcgggcggtgaatccatcacgctgcgcgtgaacaaccagaacgtgcagacctggacgctgggcacgtcgatgcagaactacaccgcatcgaccacgctctccggtggcatcaccgtcgcgtacaccaacgacagcggcaatcgcgacgtgcaggtggactacatcgtcgtgaacggcgccacccgccagtccgaggcgcagagctacaacaccggtctctatgccaacggtcgttgcggcggcggctccaacagcgagtggatgcactgcaacgggcagatcggctacgggaatactccctag

SEQ ID NO: 226 - protein, 352 aa, Unknown
  Obtained from an environmental sample
  SIGNAL (1)...(25)
MFVSLRKTAWACLLLAGLGISTSQAQTCITSSGTGTNNGHYYSFWKDSGGTVNFCMYANGRYTSNWSGINNWVGGKGWQTGSRRTISYSGSFNSPGNGYLTLYGWTTNPLIEYYIVDNWGTYRPPGGSGYMGTVTSDGGTYDVYRTQRVNQPSIIGTATFYQYWSVRQQKRTGGTITTGNHFDAWAAYGMNLGTHNYQIMATEGYQSSGSSDITVSEGGGSSSSSSSSSSSSSSSSSGGGGTKSFTVRARGTAGGESITLRVNNQNVQTWTLGTSMQNYTASTTLSGGITVAYTNDSGNRDVQVDYIVVNGATRQSEAQSYNTGLYANGRCGGGSNSEWMHCNGQIGYGNTP

SEQ ID NO: 227 - DNA, 747 bp, Unknown
  Obtained from an environmental sample
atgggcggcacgactggtagtggcggctcagccgccgccggcgcaggcacgagtggaagcgcgggcggtaccgccggagcgctcggccccggcggtacccagggcagcggtggcgcagccggtggtacgagcggaacgggcggggccatcagcagcagctgcacggaagctgacaagacggtctgcaacaacgaaaccggtcgccactgcaattacacgtacgagtattggaaggaccagggaagcggttgcctcgtgaacaaagccgacggcttcagcgtcaactggaacaacatcaacaatctgctgggtcgcaagggtctgaggcccggatcgtcgaatcagacggtgacctaccaggcaaactaccagccgaacggcaattcatacctgtgcgtatatggatggacgcaaaaccccctcgtcgaatactacatcgtcgatagctggggcagctggcgcccgccggggggaacgtccatgggcaccgtcaacgcggacggcggcacctacgacatctaccgcacccagcgcgtcaaccagccttccatcgaaggcaccaagaccttctatcaatactggagcgttcgcactcagaagcgcacgagcggaacgatcacggttgccgctcacttcgacgcctgggcgacgaaggggatgaacatggggagtctgtacgaggtgtcgatgaccgtcgagggctatcaaagcagcgggaccgccgacgtgagcttctcgatgaagtga

SEQ ID NO: 228 - protein, 248 aa, Unknown
  Obtained from an environmental sample
  SIGNAL (1)...(39)
MGGTTGSGGSAAAGAGTSGSAGGTAGALGPGGTQGSGGAAGGTSGTGGAISSSCTEADKTVCNNETGRHCNYTYEYWKDQGSGCLVNKADGFSVNWNNINNLLGRKGLRPGSSNQTVTYQANYQPNGNSYLCVYGWTQNPLVEYYIVDSWGSWRPPGGTSMGTVNADGGTYDIYRTQRVNQPSIEGTKTFYQYWSVRTQKRTSGTITVAAHFDAWATKGMNMGSLYEVSMTVEGYQSSGTADVSFSMK

SEQ ID NO: 229 - DNA, 642 bp, Unknown
  Obtained from an environmental sample
atgtttaagtttacaaagaaattcttagttgggttaacggcagctttgatgagtattagcttgttttcggcaaacgcctctgcagctaacacagactactggcaaaattggactgatgggggcggaacagtaaacgctgtcaatgggtctggcgggaattacagtgtgaattggtctaataccgggaatttcgttgttggtaaaggttggactacaggttcgccatttaggacgataaactataatgccggagtttgggcgccgaatggcaatgcatatttgactttatatggttggacgcgatcacccctcatagaatattatgtagtggattcatggggtacttatagacctactggaacgtataaaggtacggtttacagtgatgggggtacatatgacgtgtacacaactacacgttatgatgcaccttccattgatggcgataaaactacttttacgcagtactggagtgttcgccagtcgaagagaccaactggaagcaacgctacaatcactttcagcaatcacgttaacgcatggaagagatatgggatgaatctgggtagtaattggtcttaccaagtcttagcgacagagggatatcaaagtagtggaagttctaacgtaacagtgtggtaa

SEQ ID NO: 230 - protein, 213 aa, Unknown
  Obtained from an environmental sample
  SIGNAL (1)...(28)
MFKFTKKFLVGLTAALMSISLFSANASAANTDYWQNWTDGGGTVNAVNGSGGNYSVNWSNTGNFVVGKGWTTGSPFRTINYNAGVWAPNGNAYLTLYGWTRSPLIEYYVVDSWGTYRPTGTYKGTVYSDGGTYDVYTTTRYDAPSIDGDKTTFTQYWSVRQSKRPTGSNATITFSNHVNAWKRYGMNLGSNWSYQVLATEGYQSSGSSNVTVW

SEQ ID NO: 231 - DNA, 1008 bp, Unknown
  misc_feature: Bacterial DNA
atgaacctgctcgtccagccgaggcgtcgcagacgcggtccggtcaccttgctcgtcaggagcgcgtgggccgtcgcgctggcggcgctcgccgcgctgatgctgccgggcaccgcccaggccgacacggtcgtcacgaccaaccaggagggcaccaacaacggctactactactcgttctggaccgacagccagggcaccgtctccatgaacatgggctccggcggtcagtacagcacctcgtggcgcaacaccggcaacttcgtcgcgggcaagggctgggccaacggcggccgccggaccgtgcagtactcgggcagcttcaacccctccggcaacgcgtacctggcgctctacggatggacgtcgaacccgctcgtcgagtactacatcgtcgacaactggggcacctaccggcccacgggcgagtacaagggcaccgtcaccagcgacggcggcacctacgacatctacaagacgacccgcgtcaacaagccctccgtcgagggcacccgcaccttcgaccagtactggagcgtccggcaggcgaagcggaccggcggcaccatcacgaccggcaaccacttcgacgcgtgggcccgggccgggatgccgctcggcaacttcagctactacatgatcatggccaccgagggctaccagagcagcggcagctccagcatcaacgtcggcgggaccggccgcggcgacaacggcggcggcgacaacgggggcggtggcggcgggtgcaccgccacggtgtccgccgggcagaagtggggcgaccggtacaacctcgacgtctccgtcagcggcgccagcgactggacggtgacgatgaacgtgccgtccccggcgaaggtcctgtcgacctggaacgtcaacgccagctatcccagtgcgcagacgctgaccgccaggtcgaacggcagcggcaacaactggggcgccaccatccaggccaacggcaactggacctggcccagcgtgtcctgcagcgcgggctga

SEQ ID NO: 232 - protein, 335 aa, Unknown
  DOMAIN (1)...(335): Bacterial protein
  SIGNAL (1)...(41)
MNLLVQPRRRRRGPVTLLVRSAWAVALAALAALMLPGTAQADTVVTTNQEGTNNGYYYSFWTDSQGTVSMNMGSGGQYSTSWRNTGNFVAGKGWANGGRRTVQYSGSFNPSGNAYLALYGWTSNPLVEYYIVDNWGTYRPTGEYKGTVTSDGGTYDIYKTTRVNKPSVEGTRTFDQYWSVRQAKRTGGTITTGNHFDAWARAGMPLGNFSYYMIMATEGYQSSGSSSINVGGTGRGDNGGGDNGGGGGGCTATVSAGQKWGDRYNLDVSVSGASDWTVTMNVPSPAKVLSTWNVNASYPSAQTLTARSNGSGNNWGATIQANGNWTWPSVSCSAG

SEQ ID NO: 233 - DNA, 1071 bp, Unknown
  Obtained from an environmental sample
atgtctatgtttttgagtctcaaaagagtggcggcgctcgtctgcgtcgcagggtttggcatttcggcggcgaacgctcagtgcgtcacttcgagccagacaggaaccaacaacgggttctatttttcgttctggaaagatagtccgggaaccgtgaatttctgcaaccagagcggtggccgctacacatccaattggagcggtatcaacaactgggtcggtggcaagggttggcagaccggctcgcgaagggtcgtgagctactccggttcgttcaattcgccgggcaacgggtatctgaccctctatgggtggaccaccaatccgctcatcgagtactacatcgtcgacaactggggctcgtatcgcccgccgggcggacaggggttcatgggcacggtgaccagcgacggcggcacgtacgatgtctaccgcacacagcgcgtcaatcaaccctgcatcaccggcagcagttgcaccttctatcaatactggagcgtgcggcagtcgaagagaacgggcggcacgatcacgacgggcaatcactttgacgcgtgggcgagttacggcatgaacctgggcgctcacaactaccagatcatggcgaccgagggttatcaaagcagcgggagctctgacatcacggtcagtgaaggcagcagcagtagcagcagtagcagcagttcgagcagtagctcgagcagcagctccagcagcagcagcggcggcggtggcaccaagagcttcacggtccgcgcgcgcggcgtggccggcggggaatccatcacgttgcgcgtgaacaatcagaacgtgcagacctggactctcggcaccggcatgcagaactacacggcgtcgacgtctttgagtggcggcatcacggttgcgtataccaacgatggcggcagtcgcgacgtgcaggttgactacatcatcgtgaacggccagacgcgtcagtcggaagcgcagagctacaacaccgggctttatgccaacggccgttgcggtggcggcggcaacagcgaatggatgcattgcaatggcgccattggctacgggaacacgccgtag

SEQ ID NO: 234 - protein, 356 aa, Unknown
  Obtained from an environmental sample
  SIGNAL (1)...(26)
MSMFLSLKRVAALVCVAGFGISAANAQCVTSSQTGTNNGFYFSFWKDSPGTVNFCNQSGGRYTSNWSGINNWVGGKGWQTGSRRVVSYSGSFNSPGNGYLTLYGWTTNPLIEYYIVDNWGSYRPPGGQGFMGTVTSDGGTYDVYRTQRVNQPCITGSSCTFYQYWSVRQSKRTGGTITTGNHFDAWASYGMNLGAHNYQIMATEGYQSSGSSDITVSEGSSSSSSSSSSSSSSSSSSSSSSGGGGTKSFTVRARGVAGGESITLRVNNQNVQTWTLGTGMQNYTASTSLSGGITVAYTNDGGSRDVQVDYIIVNGQTRQSEAQSYNTGLYANGRCGGGGNSEWMHCNGAIGYGNTP

SEQ ID NO: 235 - DNA, 1539 bp, Unknown
  Obtained from an environmental sample
atgtcgaataacagatttgtgctgaatcgtgttgctgcaggtttgctgctgggtttctcgctgctgtcatcagcagccatcgcccagaatgtggtggtaaatccttctacggtccatcagaccgtgcgcggctttggcggcatgaacgcgccgggctggattgatgaccttaccaccgcccaggtcaataaggcctatggcagtggcgatggccaggtcgggctctccatcatgcgcatgcgcattgatccgaactcggcagcctggaatatccaggtgccggctgccaagcgggccaaggagctgggtgcgatcctgtttgccacgccctggtcgccgcccgcctacatgaaatccaacaaaagcctgaataacggcggcaagctgctgcccgagtattacagcgcctacaccacccacctgctggattttgcgagtttcatgtcgcgcaacggcgcaccgctgtatgcgatttcaatccagaacgaaccggactggctgccggattatgagtcgtgtgcctggactggtactgatttcgtcaattatctgaatacccagggctcgcgttttggtgatctgaaagtgattgcgccggaatccctgggtttcacgacctcgtattccgaccccatcctcaacagcgccacggcagcgccgcatgtcgacatcatcggcggccacctctacggcgtgctgcccaaggactacccgctggcgcgccagaagggcaaggaaatctggatgaccgagcattacaccgagagcaagaactcgggtgatgcctggccgctggcgctggacgtaggcaccgagctgcaccagagcatggtggccaactacaacgcctacgtgtggtggtatgtgcgccgcagctacggcctgctgctggagaacggcaatgtgagcaagcgcggctacatcatgtcgcagtacgcacgcttcgtccgccccggctccaagcgcatcggcgcgacggaaaagccgcacgccgacgtggcggtgacggcctacaagacgccggataaccgcattgtgctggtggcggtgaataccggtgcggcgcaccgtcagctgaacatcacggtgccgagcggcagcgtgggttctttcagcaagttctccacttccggcacgctgaatgtgggcagtggtggcagctacaaggtcaacaacggcgcggtgagcctgtacatcgatccgcagagcgtggccacgctggtgggtgatctgcccggcacggcctccagctcttcggcggcgtcctcgtcctcttccagtgcagccagctctgcttcgagcagtgctagcggcgcaccggccctgtctggcagcagcgattaccccacgggcttcagcaagtgcgctgatctgggtggtacttgtgccgtgccttcgggctcgggctggacggctttcgggcgcaagggcaagtgggttgccaagtacgtcggtgtgggcaagagcattgcctgcacggtgacggctttcggcagcgatcccggtggtgcacccaacaagtgttcttaccagaagtaa

SEQ ID NO: 236 - protein, 512 aa, Unknown
  Obtained from an environmental sample
  SIGNAL (1)...(28)
MSNNRFVLNRVAAGLLLGFSLLSSAAIAQNVVVNPSTVHQTVRGFGGMNAPGWIDDLTTAQVNKAYGSGDGQVGLSIMRMRIDPNSAAWNIQVPAAKRAKELGAILFATPWSPPAYMKSNKSLNNGGKLLPEYYSAYTTHLLDFASFMSRNGAPLYAISIQNEPDWLPDYESCAWTGTDFVNYLNTQGSRFGDLKVIAPESLGFTTSYSDPILNSATAAPHVDIIGGHLYGVLPKDYPLARQKGKEIWMTEHYTESKNSGDAWPLALDVGTELHQSMVANYNAYVWWYVRRSYGLLLENGNVSKRGYIMSQYARFVRPGSKRIGATEKPHADVAVTAYKTPDNRIVLVAVNTGAAHRQLNITVPSGSVGSFSKFSTSGTLNVGSGGSYKVNNGAVSLYIDPQSVATLVGDLPGTASSSSAASSSSSSAASSASSSASGAPALSGSSDYPTGFSKCADLGGTCAVPSGSGWTAFGRKGKWVAKYVGVGKSIACTVTAFGSDPGGAPNKCSYQK

SEQ ID NO: 237 - DNA, 1269 bp, Unknown
  Obtained from an environmental sample
atgattccacgcataaaaaaaacaatttgtgtactattagtatgtttcactatgctgtcagtcatgttagggccaggcgctactgaagttttggcagcaagtgatgtaacagttaatgtatctgcagagaaacaagtgattcgcggttttggagggatgaatcatccggcttgggctggggatcttacagcagctcaaagagaaactgcttttggcaatggacagaaccagttaggattttcaatcttaagaattcatgtagatgaaaatcgaaataattggtataaagaggtggagactgcaaagagtgcggtcaaacacggagcaatcgtttttgcttctccttggaatcctccaagtgatatggttgagacctttaatcggaatggtgacacatcggctaaacggctgaaatacaacaagtacgcagcatacgcgcagcatcttaacgattttgttaccttcatgaagaataatggtgtgaatctttacgcgatttcggtccaaaacgagcctgattacgctcacgagtggacgtggtggacgccgcaagaaatacttcgctttatgagagaaaacgccggctcgatcaatgcccgcgtcattgcgcctgagtcatttcaatacttgaagaatttgtcggacccgatcttgaacgatccgcaggctcttgccaatatggatattctcggaactcacctgtacggcacccaggtcagccaattcccttatcctcttttcaaacaaaaaggagcggggaaggacctttggatgacggaagtatactatccaaacagtgataccaactcggcggatcgatggcctgaggcattggatgtttcacagcatattcacaatgcgatggtagagggggactttcaagcttatgtatggtggtacatccgaagatcatatggacctatgaaagaagatggtacgatcagcaaacgcggctacaatatggctcatttctcaaagtttgtgcgtcccggctatgtaaggattgatgcaacgaaaaaccctaatgcgaacgtttacgtgtcagcctataaaggtgacaacaaggtcgttattgttgccatcaataaaagcaacacaggagtcaaccaaaactttgttttgcagaatggatctgcttcaaacgtatctagatggatcacgagcagcagcagcaatctacaacctggaacgaatctcactgtatcaggcaatcatttttgggctcatcttccagctcaaagcgtgacaacatttgttgtaaatcgttaa

SEQ ID NO: 238 - protein, 422 aa, Unknown
  Obtained from an environmental sample
  SIGNAL (1)...(32)
MIPRIKKTICVLLVCFTMLSVMLGPGATEVLAASDVTVNVSAEKQVIRGFGGMNHPAWAGDLTAAQRETAFGNGQNQLGFSILRIHVDENRNNWYKEVETAKSAVKHGAIVFASPWNPPSDMVETFNRNGDTSAKRLKYNKYAAYAQHLNDFVTFMKNNGVNLYAISVQNEPDYAHEWTWWTPQEILRFMRENAGSINARVIAPESFQYLKNLSDPILNDPQALANMDILGTHLYGTQVSQFPYPLFKQKGAGKDLWMTEVYYPNSDTNSADRWPEALDVSQHIHNAMVEGDFQAYVWWYIRRSYGPMKEDGTISKRGYNMAHFSKFVRPGYVRIDATKNPNANVYVSAYKGDNKVVIVAINKSNTGVNQNFVLQNGSASNVSRWITSSSSNLQPGTNLTVSGNHFWAHLPAQSVTTFVVNR

SEQ ID NO: 239 - DNA, 1281 bp, Unknown
  Obtained from an environmental sample
atgaatcgtttcttgatttcacgttataagaaagccataagtgcatgtttggcccttgtccttgcgttgtctctcatggcggcacctggcgatgttgccgcagccagcgacgccgttataaatgtatcgtcggagaaacaagtgatacgcggtttcggaggcatcaaccacccggcatggatcggagatttgacggcagcacagagagaaaccgcatttgggaacgggccaaatcagttaggcttctcgatattaagaatctacgtgcatgaagaccgaaatcagtggcaccgtgaactggatacggccaaacgagcgattgcccttggagctatcgtattcgcttcgccatggaatccgcccgccgacatggtcgagaccttcaaccgcaacggcgatacgtcggcaaagcgacttcgttacgacaagtataccgcctatgcccagcatcttaacgatttcgtaacctacatgagaaacaatggcgtgaatctctacgcgatttccgtccagaacgagcccgattatgcgcatgactggacgtggtggactccgcaggaaatgcttcgctttatgaaagaaaatgccggatcgatcaacagcagagtgatcgcaccggaatcgttccaatatctgaaaaatatgtcggacccgattctaaatgatccccaggcgcttgccaatatggatattcttggcgctcatctgtacggtacccaagttagcaatttcgcgtatccactattcaaacaaaaaggagcgggaaaagacctctggatgaccgaggtgtattacccgaacagcgacaacaactcggcggatcgctggcccgaagccctggatgtgtcttaccatatccacaatgcgatggtagagggagattttcaagcttatgtatggtggtatatccgcagatcctatggtccaatgaaagaggacggcacgatcagcaaacgcggctacaatatggctcatttctccaagtttgtccgtcccggctatgtcagggtggatgcttcgaaaaatccagaaacgaacgtttacgtatccgcatataaaggcgacaacaaaatcgttatcgttgccataaaccggaacaactccggggtcaatcagaactttgtccttcagaatggatccgtttcgcaggtatcaaggtggatcacgagcagcagcagcaatctccagccaggaacgtctctcaatgtaacagggagcaatttctgggctcatcttcccgcgcaaagcgttacgacttttgtgggtgaactcggaaggtaa

SEQ ID NO: 240 - protein, 426 aa, Unknown
  Obtained from an environmental sample
  SIGNAL (1)...(30)
MNRFLISRYKKAISACLALVLALSLMAAPGDVAAASDAVINVSSEKQVIRGFGGINHPAWIGDLTAAQRETAFGNGPNQLGFSILRIYVHEDRNQWHRELDTAKRAIALGAIVFASPWNPPADMVETFNRNGDTSAKRLRYDKYTAYAQHLNDFVTYMRNNGVNLYAISVQNEPDYAHDWTWWTPQEMLRFMKENAGSINSRVIAPESFQYLKNMSDPILNDPQALANMDILGAHLYGTQVSNFAYPLFKQKGAGKDLWMTEVYYPNSDNNSADRWPEALDVSYHIHNAMVEGDFQAYVWWYIRRSYGPMKEDGTISKRGYNMAHFSKFVRPGYVRVDASKNPETNVYVSAYKGDNKIVIVAINRNNSGVNQNFVLQNGSVSQVSRWITSSSSNLQPGTSLNVTGSNFWAHLPAQSVTTFVGELGR

SEQ ID NO: 241 - DNA, 1695 bp, Unknown
  Obtained from an environmental sample
gtgaagatattgaaatttaagatgaatttaaaaaaatcggttcatgttctgttggcctgtttaacagccctgcctctcatgttaacgccgacacacgtatcagcagcaagtgatgccaacattaatttgtcctccgaaaaacagcttatcaaggggtttggaggtattaaccacccagcctggattggcgacttgacggcagctcagcgtgaaacagcctttggcaacggagcgaaccagcttggtttttccatactaagaatctatgtcgatgaaaatccaaacaactggtacagggaggtggctactgccaaaagagccatagagcaaggtgccatcgtattcgcttctccctggaatccaccaagtgacatggtcgaaaccttcaatcggaacggggatacgaacgccaaacgattgagatacgacaaatatgctgcgtacgcgcagcatctgaacgactttgtcagttatatgaaaaataacggtgtggatctgtatgccatttcggtacaaaatgagccggattatgcccatgaatggacctggtggactccgcaggagatccttcgtttcatgaaggagaatgcgggatccattcagaataccaaagtcatggcacctgaatcgttccagtatttgaaaaacatgtctgacccgattctgaatgatcctcaggcactcgccaatatggacattctgggagctcatacgtacgggacacagttcaaagatttcgcatacccgctctttaagcaaaagggagccggcaaagaactgtggatgacagaagtgtattacccgaacagcgataacaactcgtcggaccgttggcctgaggcattggacgtatcttaccatatgcataatgccatggttgaaggagattttcaggcttacgtatggtggtatattcggagacagtacggtccgatgaatgagaacgggactattagcaaacgtggttacaatatggcccatttctccaaatttgtgcgaccaggctattaccgtgtcgatgcaaccaaaaatccggataccaataccttcgtctcagcctataaaggtgataataaggcagtcattgtggcgattaatcgcggcacctcggctgtaagccaaaaattcgttcttcagaatggtaacgcttctactgtatcctcttgggttacggatagcagccgaaacctggcaagcggagcgccgattacgatgtcaggtggagcctttacagcacaactgccagcccaaagcgtaacaacgtttgtagccaacattactggtggtagtgtcactccaggcagcggaaccacgtacgaggcggaaacgggcactacacttaccgatgccgtgatcgagactctctacccgggatacactgggaccggatacgtgaactttaatgcgtatactggttcggccattcaatggaatgccatcaataacacgataacaggtaccaaaaatgtgaaatttcgttacgcccaggaaagcggaacgcgtaatctcgacattttcgttaacggaactaaagtcatcagcaacgaacctttcccggcaacaggcagctggtcgacctggagtgaaaaaactattcaggtccccatgaacgcgggaaccaatacgattaaagtggtcacaaccggtacagaagggccaaatattgataacatcaatgtcactgcagtccaataa

SEQ ID NO: 242 - protein, 564 aa, Unknown
  Obtained from an environmental sample
  SIGNAL (1)...(28)
VKILKFKMNLKKSVHVLLACLTALPLMLTPTHVSAASDANINLSSEKQLIKGFGGINHPAWIGDLTAAQRETAFGNGANQLGFSILRIYVDENPNNWYREVATAKRAIEQGAIVFASPWNPPSDMVETFNRNGDTNAKRLRYDKYAAYAQHLNDFVSYMKNNGVDLYAISVQNEPDYAHEWTWWTPQEILRFMKENAGSIQNTKVMAPESFQYLKNMSDPILNDPQALANMDILGAHTYGTQFKDFAYPLFKQKGAGKELWMTEVYYPNSDNNSSDRWPEALDVSYHMHNAMVEGDFQAYVWWYIRRQYGPMNENGTISKRGYNMAHFSKFVRPGYYRVDATKNPDTNTFVSAYKGDNKAVIVAINRGTSAVSQKFVLQNGNASTVSSWVTDSSRNLASGAPITMSGGAFTAQLPAQSVTTFVANITGGSVTPGSGTTYEAETGTTLTDAVIETLYPGYTGTGYVNFNAYTGSAIQWNAINNTITGTKNVKFRYAQESGTRNLDIFVNGTKVISNEPFPATGSWSTWSEKTIQVPMNAGTNTIKVVTTGTEGPNIDNINVTAVQ

SEQ ID NO: 243 - DNA, 1272 bp, Unknown
  Obtained from an environmental sample
atgatttcaagcgtaaaaaaaccaatttgtgtattattggtatgtttcactatgctgtcagtcatgttagccgggccaggtgctactgaagttttagcagcaagtgatgtaacaattaatttatctgcagaaaaacaagtgatccgcggttttggaggcatgaaccacccggcttggattggagatttgacagcagctcaaagagaaaccgcttttggcaatggacagaatcagttaggtttttcaatcttaagaattcatgtggatgaaaatagaaataattggtacagagaagtggagactgcaaagagtgcgatcaaacatggagcaatcgtttttgcttctccctggaatcctccaagcgatatggttgagactttcaatcgtaatggtgacacatcagctaaacggctaagatacgataagtacgccgcatacgcgcagcatcttaacgattttgttacctacatgaagaataatggcgtgaatctttatgcgatttctgttcaaaacgagcctgattatgcgcacgaatggacgtggtggactccgcaagaaatacttcgtttcatgagagaaaatgccggttccattaatgcacgtgtcattgcaccagaatcttttcagtactttaaaaatatatcggaccccattttgaacgatccacaggcgcttaggaatatggatattctcggaactcacctgtacggtactcaggtcagtcagtttccttatcctctattcaaacaaaaaggagcagggaaagagctatggatgacggaagtatactatccaaacagtgacaacaattcagcggatcgctggcccgaggcattaggcgtttcagagcatattcaccattcaatggtggagggagattttcaatcttatgtttggtggtacatccgcagatcttacggtcctatgaaagaggacggtacgatcagcaaacgcggttacaatatggctcatttctcgaagtttgtgcgtcccggctatgtaagggtagatgcaacgaaaaatcctaatgcgaacgtttacgtgtcagcctataaaggtgacaacaaggtcgttattgttgccattaacaaaagcaatacaggggtcaaccaaaactttgtgttgcagaatggatctgcttctcaggtatctaggtggataacaagcggaagcagcaatcttcaacctggaacgaatctcaatgtaacgggcaatcatttttgggcccatcttccagctcaaagcgtgacaacatttgtcgcaaatcgttaa

SEQ ID NO: 244 - protein, 423 aa, Unknown
  Obtained from an environmental sample
  SIGNAL (1)...(33)
MISSVKKPICVLLVCFTMLSVMLAGPGATEVLAASDVTINLSAEKQVIRGFGGMNHPAWIGDLTAAQRETAFGNGQNQLGFSILRIHVDENRNNWYREVETAKSAIKHGAIVFASPWNPPSDMVETFNRNGDTSAKRLRYDKYAAYAQHLNDFVTYMKNNGVNLYAISVQNEPDYAHEWTWWTPQEILRFMRENAGSINARVIAPESFQYFKNISDPILNDPQALRNMDILGTHLYGTQVSQFPYPLFKQKGAGKELWMTEVYYPNSDNNSADRWPEALGVSEHIHHSMVEGDFQSYVWWYIRRSYGPMKEDGTISKRGYNMAHFSKFVRPGYVRVDATKNPNANVYVSAYKGDNKVVIVAINKSNTGVNQNFVLQNGSASQVSRWITSGSSNLQPGTNLNVTGNHFWAHLPAQSVTTFVANR

SEQ ID NO: 245 - DNA, 1263 bp, Unknown
  Obtained from an environmental sample
atgtcaatgatcaaaaaaccaatctgcactttattgatctgcttcaccatgctgtctgtcatgttcatcggacctggcgtgactgaggtttcagcagcagatgccaatattaatatcaatgcggaaagacaagtgattcgcggctttggcggaatgaaccatccggcttggattggtgatttgaccgcacctcaaagggaaaccgcctttggcaatgggcagaatcaattaggattttccattctaagaatttttgtagatgagaaccgaaataattggcacagagaggtcgctactgccaaaagagcaatagagcatggagctttggtgatcgcttcaccatggaatcctccaagcaatatggtagagaccttcaaccggaatggtacatctgcaaagcggctcagatacaaccaatacgccgcatatgctcagcatctgaacgattttgtgacgtatatgaaaaataatggcgtcaatctctatgctatatctgtacaaaatgagcccgattatgcacacgaatggacatggtggactcctcaggaaatcctgcgtttcatgagagaaaatgctggctccattaatgcccgcgtgatcgcaccagaatcctttcaataccttaaaaatatatcagatcctatcctaaacgatccgcaggcgcttggaaacatggacattctcggagcccatttgtacggaacccaaatcagccagcttccgtatcctcttttcaaacaaaagggagggggaaaggagctttggatgacagaggtctactacccgaatagcgataacaattcagcggaccgctggcctgaagcattaggggtttcagagcatattcaccattcgatggtagaaggggactttcaggcatatgtttggtggtacattcgcagatcctacggccctatgaaagaagacggtctaatcagcaaacgtggttacaacatggcgcatttctccaagtttgtacgcccaggatacatcagaattgatgcaacgaaaagtcctgaaccgaatgttttcgtatcagcctataaaggaaacaatcaagtcgtcattgtcgcgattaacaaaaacaatacaggagtcaatcagcactttgtgatgcaaaacggaactgcttcacaagcgtcaagatggatcacaagtagcaacagcaaccttcagcctggtacagacttaaatatatcaggtaatcaattttgggctcatctcccggctcaaagtgtgacaacatttgtggtcaaacgctag

SEQ ID NO: 246 - protein, 401 aa, Unknown
  Obtained from an environmental sample
  SIGNAL (1)...(32)
MSMIKKPICTLLICFTMLSVMFIGPGVTEVSAADANININAERQVIRGFGGMNHPAWIGDLTAPQRETAFGNGQNQLGFSILRIFVDENRNNWHREVATAKRAIEHGALVIASPWNPPSNMVETFNRNGTSAKRLRYNQYAAYAQHLNDFVTYMKNNGVNLYAISVQNEPDYAHEWTWWTPQEILRFMRENAGSINARVIAPESFQYLKNISDPILNDPQALGNMDILGAHLYGTQISQLPYPLFKQKGGGKELWMTEVYYPNSDNNSADRWPEALGVSEHIHHSMVEGDFQAYVWWYIRRSYGPMKEDGLISKRGYNMAHFSKFVRPGYIRIDATKSPEPNVFVSAYKGNNQVVIVAINKNNTGVNQHFVMQNGTASQASRWITSSNSNLQPGTDLNISG

SEQ ID NO: 247 - DNA, 1044 bp, Unknown
  Obtained from an environmental sample
gtgtttgccaacgatttcctgataggcgtggcgctcaactcacggcaggtcgccggggaatccgaggccggaaaactagctggcgcgcaattttcgtcggtgacggcggagaatgagatgaagtggcagtcgctccatccccagcccgaccgctatcagttcggcgcggcggactcctacatcgattttgccaaaaaacacaagatggcggtgatcggccacacgctcgtgtggcacagccagacacccggctgggtgttcgagggcaaggacggcaagccggcgacccgcgaggatctgctcaagcgcatgcgcgatcacatccacaccgtggccggacgctacaagggcaaggtgcgcggctgggacgtggtcaacgaggccttgtccgacggcggtcccgaaatcctgcgggattctccgtggcggcgcatcatcggcgatgacttcatcgaccacgcgttccgtttcgcccgtgaggccgatccgaaagccgaactctactacaacgactacggtctcgagaacgaaaggaagcggagcaactgcatcaagctcgtcaagggcatgaaacaacgcggcgtgccgatcgacggggtgggcacccagtcgcatttccacttgaaacatccctcgctccaggaaatcgaaaagaccatcaaggacttttccgaactcggactcaaggtgatgatcaccgagctggatgtcgatgtgctgccgtcgcgtggcaatttcggcaacgccgacatcagccgccgcgagcagggcggtgacgcactcaatccttacaccggcggcttgcccgatgaggtccaacaggaacttgcgaaacgctatgcggacatttttgatatctatctgcgccaccggaaggcggtcacccgcgtaaccttctggggactcgatgacgggcatacctggttgaacggtttcccgatccgcggacgcaccaactatccgctgttgttcgaccgcgccctcaagccgaagcccgcgttcgaggcggtcatcaaaaaagggcttgaacccaggaaacgttga

SEQ ID NO: 248 - protein, 347 aa, Unknown
  Obtained from an environmental sample
VFANDFLIGVALNSRQVAGESEAGKLAGAQFSSVTAENEMKWQSLHPQPDRYQFGAADSYIDFAKKHKMAVIGHTLVWHSQTPGWVFEGKDGKPATREDLLKRMRDHIHTVAGRYKGKVRGWDVVNEALSDGGPEILRDSPWRRIIGDDFIDHAFRFAREADPKAELYYNDYGLENERKRSNCIKLVKGMKQRGVPIDGVGTQSHFHLKHPSLQEIEKTIKDFSELGLKVMITELDVDVLPSRGNFGNADISRREQGGDALNPYTGGLPDEVQQELAKRYADIFDIYLRHRKAVTRVTFWGLDDGHTWLNGFPIRGRTNYPLLFDRALKPKPAFEAVIKKGLEPRKR

SEQ ID NO: 249 - DNA, 1439 bp, Unknown
  Obtained from an environmental sample
tgatcaatccagtgaaggatcttcgtgaagatttcatctttggaatggacgtttcaatgctctacgagatagagcggctcggtggtaagttcttcgatggtggtgtggagaaagatcttttccagatactgaaggatcatgagataaactggatcagattgagagtgtggaacgatccaagggatgaaaacggaaatccgctcggtgggggaaactgtgattatctgaaaatgacagagatcgcaaaaagggccaaaaagtacggaatgaaggttcttcttgactttcactacagcgactggtgggcagatcccggcaagcagtacaaaccaaaagagtgggatcaccttcatggagaacttctggaaagggcggtgtattcctacacgaaactcgtgctgaatcatatgagaagaaacggtgcactgccggacatggtccaggtgggaaacgaggtgaacaacggctttctctggccggatggaatgattgccggaaaggatgcaggaggattcgacggattcacaaaacttttgaaggcggccatcaaagccgtcagggaagttgatcccgatatcaagatagtcattcatttggcagaaggtggaaacaactcacttttcaggtggttcttcgacgagatcacaagaagagacgtggattttgatgtgatcggtgtatcgtactatccgtactggcatggtaccctggatgacctgaagaacaacctgtacgacatagcgaaaagatacaacaaagacgtgctcatcgttgaaacggcgtatgcctggacactcgaggacggggacggttaccccaacatcttcagtggtgaagagatggagctcacgggtggttacaaagcaacggttcagggacaggcaacgttcttgagggatctcatagaagtggtgaacagtgttcctgacggtcacggtcttgggatcttctattgggaaggagactggattcctgtgaaaggagccggctggaaaaccggcgaaggaaatccatgggagaatcaggccatgtttgatttcaatggaaatgctctcccatccctggatgttttcaagctcgtgaggacagtcactcctatggaaataaaaatcgaagagattctgcctgtggagatctcgacgaatttgggagagattccgaagtttccggatgctgtgaaagtgctgttcagcgatgattccatcagatccctgaaagttacatggaattttgatccttctcttgttgaaacacccggtgtctacagagtggaaggatacgtggaaagtatagaccagaagatcttcgcaaccttgactgtgaagggaagtagaaactacctgaagaaccctgggtttgaaacgggtgagttttctccctggaaggtgttcggtaacggaaaacgcagtgaaggtggtaaaggccgatcctccgagtaa

SEQ ID NO: 250 - protein, 479 aa, Unknown
  Obtained from an environmental sample
  SIGNAL (1)...(33)
MINPVKDLREDFIFGMDVSMLYEIERLGGKFFDGGVEKDLFQILKDHEINWIRLRVWNDPRDENGNPLGGGNCDYLKMTEIAKRAKKYGMKVLLDFHYSDWWADPGKQYKPKEWDHLHGELLERAVYSYTKLVLNHMRRNGALPDMVQVGNEVNNGFLWPDGMIAGKDAGGFDGFTKLLKAAIKAVREVDPDIKIVIHLAEGGNNSLFRWFFDEITRRDVDFDVIGVSYYPYWHGTLDDLKNNLYDIAKRYNKDVLIVETAYAWTLEDGDGYPNIFSGEEMELTGGYKATVQGQATFLRDLIEVVNSVPDGHGLGIFYWEGDWIPVKGAGWKTGEGNPWENQAMFDFNGNALPSLDVFKLVRTVTPMEIKIEEILPVEISTNLGEIPKFPDAVKVLFSDDSIRSLKVTWNFDPSLVETPGVYRVEGYVESIDQKIFATLTVKGSRNYLKNPGFETGEFSPWKVFGNGKRSEGGKGRSSE

SEQ ID NO: 251 - DNA, 555 bp, Unknown
  Obtained from an environmental sample
atggctacggattattggcaatattggacggatggcggcggaacggtgaatgcggttaacgggtccgggggcaattacagcgtaacttggcaaaatagcggggacttcgtggtcggcaaaggctggagcgtagggtcgccaaatcggacgatcaattacaatgccggcatctgggaaccttcggggaacgggtacttgaccctttacggatggactagaaactcgctgatcgagtattacgttgtcgacagttgggggacgtaccggccaacaggtactcacaaaggaacggtgaacagcgacggaggcacctacgatatttatacgaccatgcgctataatgcgccttccattgatggcacgcagacgttccaacagttctggagcgtgcggcaatcgaaacgaccaaccggcagcaacgtctccatcaccttcagcaatcacgtgaatgcctggagaagcaagggcatgaacctgggcagcagctggtcgtaccaggtcttggcgacggaaggctatcagagcagcggaagatccaacgtcacggtgtggtaa

SEQ ID NO: 252 - protein, 184 aa, Unknown
  Obtained from an environmental sample
MATDYWQYWTDGGGTVNAVNGSGGNYSVTWQNSGDFVVGKGWSVGSPNRTINYNAGIWEPSGNGYLTLYGWTRNSLIEYYVVDSWGTYRPTGTHKGTVNSDGGTYDIYTTMRYNAPSIDGTQTFQQFWSVRQSKRPTGSNVSITFSNHVNAWRSKGMNLGSSWSYQVLATEGYQSSGRSNVTVW

SEQ ID NO: 253 - DNA, 1047 bp, Unknown
  Obtained from an environmental sample
atgattgttagcttcaagagcctgaaggcactcgcgtgcctcggcgtgctcggcatcaccgccgcgcacgcgcaaacctgcatcacgtcgagccagacgggcaccaacaacggcaattacttttcgttctggaaagacagtccgggcacggtgaacttctgcatgtatgcgaatggccgctatacctccaactggagcggcatcaacaactgggtgggcggcaagggctgggctaccggctccagccacacgatcagctactccggcacgttcaattcgccgggcaacggttacctggccctgtatggctggaccaccaatccattggtcgagtactacatcgtcgacagctggggtacctaccgtccgccgggcggccagggtttcatgggcacggtagttagcgacgggggcacgtacgacgtgtaccggacgcaacgcgtgaaccagccatccatcatcggcaacgccacgttctaccagtactggagcgtgcggcagtcgaagcgcgtgggcggcaccatcaccatcgccaaccatttcaacgcctgggccacgctgggcatgaacctgggccagcacaactaccaggtcatggccaccgagggttaccagagcagcggcagctccgacatcaccgtgaccgaaggtggcggcagytcctcgtcgtcctcgggcggcggcagcaccagcagcagtggtggcggcggcaacaagagcttcacggtgcgtgcgcgcggcacggccggaggcgagaacatccagctgcaggtgaacaaccagacggtcgcgagctggaacctcaccaccagcatgcagaactacaccgcctcgaccagcctgagcggcggcatcaccgtgctctacaccaacgacggcggcagccgcgacgtgcaggtggactacatcatcgtgaacggccagacccgccagtccgaagcgcagagctacaacaccgggttgtatgcgaatggacgctgcggcggtggctcgaacagcgagtggatgcattgcaacggcgcgatcggctacggcaatacgccctga

SEQ ID NO: 254 - protein, 347 aa, Unknown
  Obtained from an environmental sample
  SIGNAL (1)...(24)
MIVSFKSLKALACLGVLGITAAHAQTCITSSQTGTNNGNYFSFWKDSPGTVNFCMYANGRYTSNWSGINNWVGGKGWATGSSHTISYSGTFNSPGNGYLALYGWTTNPLVEYYIVDSWGTYRPPGGQGFMGTVVSDGGTYDVYRTQRVNQPSIIGNATFYQYWSVRQSKRVGGTITIANHFNAWATLGMNLGQHNYQVMATEGYQSSGSSDITVTEGGGSSSSSGGGSTSSSGGGGNKSFTVRARGTAGGENIQLQVNNQTVASWNLTTSMQNYTASTSLSGGITVLYTNDGGSRDVQVDYIIVNGQTRQSEAQSYNTGLYANGRCGGGSNSEWMHCNGAIGYGNTP

SEQ ID NO: 255 - DNA, 1137 bp, Unknown
  Obtained from an environmental sample
ttgatcttttccgtcagtggttccgcgtctcggcggcgccctggcatccacaagggggattccatgattttcggtctaaagtcgatcacgggcaggcgcgccgtcgcggcgctggcctgccttgccggcctctacatggcgccggcgaatgcgcaaacctgcatcacgtcgagccagacgggcaccaacaacggcaactacttttcgttctggaaagacagcccgggcacggtgaacttctgcatgtactccggcggccgctacacgtccaactggagcggcatcaacaactgggtgggcggcaagggctggcagacgggctcgtcccgcaccgtctcctactccggcagcttcaattcgccgggtaacggctacctgacgctctacggctggaccaccaatccgctcatcgagtactacatcgtcgacaactggggcagctatcgtccgccgggtggccagggcttcatgggcacggtgaacaccgacggcggcacgtacgacatctatcgcacgcaacgggtcaaccagccgtcgatcatcggcaccgcgacgttctaccagtactggagcgtgcggcagtcgaagcgcaccggcggcaccatcaccacggccaaccacttcaatgcctgggccagcctcggcatgaacctgggacagcacaactaccaggtgatggccaccgagggctaccagagcagcggcagctccgacatcacggtgtgggaaggcacgagcagcggcggaagcagcaatggcggcagcagcaacggcggcagcagcaatggtggcagcggcggcacgaagagcttcacggtgcgcgcgcgcggcactgcgggcggcgagtccatcacgctgcgggtcaacaaccagaacgtgcagacctggacgctgggtaccagcatgcagaactacacggcctcgacctcgctgagcggcggcatcacggtggcgttcaccaacgacggcggcagccgcgacgtgcaggtggactacatcatcgtgaatggccagacccgccagtccgaacagcagagctacaacactggcctctacgccaatggaagctgtggtggcggttcgaacagcgagtggatgcattgcaacggcgccatcggctacggcaatacgccctga

SEQ ID NO: 256 - protein, 378 aa, Unknown
  Obtained from an environmental sample
  SIGNAL (1)...(51)
LIFSVSGSASRRRPGIHKGDSMIFGLKSITGRRAVAALACLAGLYMAPANAQTCITSSQTGTNNGNYFSFWKDSPGTVNFCMYSGGRYTSNWSGINNWVGGKGWQTGSSRTVSYSGSFNSPGNGYLTLYGWTTNPLIEYYIVDNWGSYRPPGGQGFMGTVNTDGGTYDIYRTQRVNQPSIIGTATFYQYWSVRQSKRTGGTITTANHFNAWASLGMNLGQHNYQVMATEGYQSSGSSDITVWEGTSSGGSSNGGSSNGGSSNGGSGGTKSFTVRARGTAGGESITLRVNNQNVQTWTLGTSMQNYTASTSLSGGITVAFTNDGGSRDVQVDYIIVNGQTRQSEQQSYNTGLYANGSCGGGSNSEWMHCNGAIGYGNTP

SEQ ID NO: 257 - DNA, 2694 bp, Unknown
  Obtained from an environmental sample
atggctgatatatctaccacaccagtcacagcctcgacagatgctgccaagaacctgtatgcctatttcctggaccagtatggcaagaagacgatttccagcgtcatggccaatgtcaactggaacaacacttgtgccgagaaagtctataaactcacgggcaagtatcctgccatgaactgctacgacttcatccacatctgtttctcgccagccaactggattgactacaccgacatcactcctgccaaggaatggcacgatgcgggcggtatcgtacagttgatgtggcatttcaatgtgcctaagagccagggggcaacagatgttacctgcacgcccagcgagaccacctttaaggcttccaatgctctggttagcggcacgtgggagaacaaatggttctacgagcagatggacaaggtcattgccaccatcctcaagttacaggacgctggcattgccgctacctggcgacctttccatgaggcagcaggcaatgcttgcgccaagcagcaggccgactggaccaaagcatggttctggtggggctacgacggtgccgacacctacaagaaactgtggattgccatgtacgactatttcaagctgaaaggcgtgaacaacctcatctggatgtggaccacccagaattataatggtgacagcagcaaatacaaccaggacaccgactggtaccctggcgacgagtatgttgacatcgtggcccgcgacctctatggctacaatgccgaccagaacctgcaggagttcagcgagattcaggctgcctatcccaacaagatggtggttctgggtgaatgcggaaaaggtgatagcggcgaccccggcaagatgtccgatgtatgggcgaaaggtgccaagtggggccacttcatggtatggtatcaaggcgaacaaggctctaccgacacgatgtgcagcgacgactggtggaaggatgccatgagcagcgccaacgtcatcacccgcgacaaggtggttatccccgatgtcacttcaaccatcgagaatgccacggatgccgtgaagaacatgggactggggtggaacctggggaacgccctcgacgccaatgcccagcaataccatgatgccacccaggacaactactggggacagcaggacattacctctgagagctgctggggtcagctacccaccaaggcagagctgatggccatgatgaaagaagccggtttcggagccatccgcgttcccgtgacatggtataaccacatggacaaggacggcaatgtggatgcagcatggatgaatcgtgtgcatgaggtggttgactatgtcatcagccagggaatgtactgcatcctcaacgtacaccacgacacgggtgccgacagctacgacagccagaagaacctcaccggctaccattggatcaaggccgacgaaaccaactacgccaccaacaaggcccgctatgagaagctgtggcagcagatagcccaggagttccgcaactacggccagctgctgctgttcgagggctataacgagatgctcgatgccaacaactcctggaattttgcacagagcagttcagcctacgatgccatcaacaaatacgcccagagctttgtcgatgtcgtacgcgccaccggtggcaacaatgcccagcgcaacctcattgtcagcacatacggcgcctgctcaggcaacggcacgtgggatgcaagagtgcaagaccccttgaagaaactgcagattcccacgggtgaaagcaaccatatcatcttcgaggttcacaactatccctccatcgtcaacaaggacaacgcgggcaactacgtcagcgatcgcaccatcagcgaaatcaaggcagagattgatgcatggcttaagaacttaaagacccacctcgtcagcaagggcgctcccgtcatcatcggcgaatggggcaccaacaacgtcgatgccggcggtggcaagacagactacgacctccataaggacctgatgttcgaatttgtcagctacatgataaagaccatgaagcagaacgacattgccaccttctactggatgggacttaccgacggcgctccacgcacctaccccgccttcacacagcccgacctggcgctgaagatgctgcaggcctatcacggcgactcttggaatccctacctgcctgacgccaaggactttcccgaaggcaaaatcacctcggccacggtgaatttcaacagccaatggggcgaactgaccatccacgatggagctattgacaagaccgtctatagaggtatcaaggtggagctggaagaaaagcctgccactggagccctgtctttcaaggtatatgccaacagtgagaaggcaacagccatcaattccaaaaccccacagttggctttcttcagttacacaggcatccagaaaatcaacctacagtggaacatagccaccaaggggagtatcaaaatcaagagcgtcaaccttatcaagcacgacgactccacagaaccctgtagtctgaaagtggcttggggttgtactctcagcgaccagaactacgccacgggcatcgaagacattactatcactcctgttcgtcatgacgatggaatcatctacaatctgagcggacagcctgtaacctctcctcagcgcggcatctacatcctcaacggaaagaaaatcatcaaatag

SEQ ID NO: 258 - protein, 897 aa, Unknown
  Obtained from an environmental sample
MADISTTPVTASTDAAKNLYAYFLDQYGKKTISSVMANVNWNNTCAEKVYKLTGKYPAMNCYDFIHICFSPANWIDYTDITPAKEWHDAGGIVQLMWHFNVPKSQGATDVTCTPSETTFKASNALVSGTWENKWFYEQMDKVIATILKLQDAGIAATWRPFHEAAGNACAKQQADWTKAWFWWGYDGADTYKKLWIAMYDYFKLKGVNNLIWMWTTQNYNGDSSKYNQDTDWYPGDEYVDIVARDLYGYNADQNLQEFSEIQAAYPNKMVVLGECGKGDSGDPGKMSDVWAKGAKWGHFMVWYQGEQGSTDTMCSDDWWKDAMSSANVITRDKVVIPDVTSTIENATDAVKNMGLGWNLGNALDANAQQYHDATQDNYWGQQDITSESCWGQLPTKAELMAMMKEAGFGAIRVPVTWYNHMDKDGNVDAAWMNRVHEVVDYVISQGMYCILNVHHDTGADSYDSQKNLTGYHWIKADETNYATNKARYEKLWQQIAQEFRNYGQLLLFEGYNEMLDANNSWNFAQSSSAYDAINKYAQSFVDVVRATGGNNAQRNLIVSTYGACSGNGTWDARVQDPLKKLQIPTGESNHIIFEVHNYPSIVNKDNAGNYVSDRTISEIKAEIDAWLKNLKTHLVSKGAPVIIGEWGTNNVDAGGGKTDYDLHKDLMFEFVSYMIKTMKQNDIATFYWMGLTDGAPRTYPAFTQPDLALKMLQAYHGDSWNPYLPDAKDFPEGKITSATVNFNSQWGELTIHDGAIDKTVYRGIKVELEEKPATGALSFKVYANSEKATAINSKTPQLAFFSYTGIQKINLQWNIATKGSIKIKSVNLIKHDDSTEPCSLKVAWGCTLSDQNYATGIEDITITPVRHDDGIIYNLSGQPVTSPQRGIYILNGKKIIK

SEQ ID NO: 259 - DNA, 1143 bp, Unknown
  Obtained from an environmental sample.
atgaagaaaattcgcttactccagggtgtttcgttggccatgtcaataatgtttcttttgtcatgtcaggcacaaaaaccagttgactctcttaaggaagcatttgatggtttgtttcttataggtactgccatgaacacccctcagatcaccggccaggatacacaaacacttgagttgataaaaaaacacatgaactccatagtggccgaaaatgtaatgaaaagtgaggtgcttcaacccagggaaggagagtttgattttactcttgccgatcagtttgttcaatttggtatcgataacaatatgcatatagttggccatacccttatatggcattcccaggcgccacgatggttttttgtggatgagaacggaaacgatgtgagccccgaaattctgaaacaaagaatgaaagaccatatttataccgtagtaggccgttataaaggcaaaattcatggatgggatgtggtgaatgagtgtataaatgacgatggttcgtggcgcaatagtaagttttaccaaattcttggtgaagattttgttaaatatgcattccagtttgcagctgaagccgatcccgatgcagagctttattacaatgattattcgatgttccttccaggacgtagggaaggcgtaattaagatggtgagaaatctgcaggaacagggaattaaaattgatggtattgggatgcagggccacctgatgattgattatccacccctcgaagattttgaaacgagtatactggcttttgccgatctgggggtgaatgtcatgataaccgaactcgatatatccgttttgccatttcctacccgcaacgtgggcgccgatgtttctctgaacattgcatacaatactgaattaaatccctacccgaatggcttacccgaagatgtagcgcagaaattacataatcggtgggtggatctttttcgcctgttcattaaacaccacgataaaattacccgtgtaaccacttggggtacagccgatgccatgtcatggaagaataactggcccattcgtggacgtacagattatcccttacttttcgatcgcgattttcagcccaaaccctttgtcgctgatataattaaggaggcattggcagccaaaagaaaattataa

SEQ ID NO: 260 - protein, 380 aa, Unknown
  Obtained from an environmental sample.
  SIGNAL (1)...(24)
MKKIRLLQGVSLAMSIMFLLSCQAQKPVDSLKEAFDGLFLIGTAMNTPQITGQDTQTLELIKKHMNSIVAENVMKSEVLQPREGEFDFTLADQFVQFGIDNNMHIVGHTLIWHSQAPRWFFVDENGNDVSPEILKQRMKDHIYTVVGRYKGKIHGWDVVNECINDDGSWRNSKFYQILGEDFVKYAFQFAAEADPDAELYYNDYSMFLPGRREGVIKMVRNLQEQGIKIDGIGMQGHLMIDYPPLEDFETSILAFADLGVNVMITELDISVLPFPTRNVGADVSLNIAYNTELNPYPNGLPEDVAQKLHNRWVDLFRLFIKHHDKITRVTTWGTADAMSWKNNWPIRGRTDYPLLFDRDFQPKPFVADIIKEALAAKRKL

SEQ ID NO: 261 - DNA, 1629 bp, Unknown
  Obtained from an environmental sample.
atgataaacaaaattggcaaaggttttttttctgcgttcatttgtgctgctgcgttgagtgtctccacagttaatgctcagcaaactgtcaccaccaacacgcaaggcacgcacgatggttttttctattcgttttggaaagacagtggtgatgcatcatttggtttgcgtgagggagggcgttacacctcgcaatggaatacttctaccaataactgggtgggtggaaaagggtggaatcccggtggtagaagggttgttcactatcaaggccaatataatgttgataattcacaaaactcttatttggcattgtatggctggacacgctcaccactgattgaatattacgtgattgaaagttacggctcgtataacccgtcgaattgcacccaaggtcggcagacctatggcacctttcagagtgatggtgcaacctatgaaattgttcgctgtcagcgagttcagcagccctctatcgatggcacacaaactttctatcaatacttcagtgtgcgtcagccgaagaaaggctttggtagtatcagtggtacgatcactgtgggcaaccattttgatgcatgggccgccgccggtttgaacctgggggaacatgattatatggtgatggctaccgagggttatcagagcaccggtagttcggatattacggtcagtgaaattaccggtggttcaggtggtggctcttcctcgggtgctaataccctggtgattcgtgctgtgggcacctctggtaatgaattgctgcgtgtcaatgtgggtggtagccctgtgcagacattgagcctttcgaccagttggcaggattttactgtcaatacggatgcaacgggtgacattaacgtagagttgtttaatgatcagggtcagggttatgaggcgcgtatcgattatgtgctggttaatggtgagacccgctacgcggccgatcagagttataacaccagtgcctgggacggcgaatgtgggggtggctcttttacccagtggatgcattgtgatggcatgattggctttggtgatatgaccggcggcaatgccggtggtggcggttcttcgggtggttctggcgccaatactctggtggtgcgtgctgtcggcacttcaggtaacgagcagttgcgcgtgaatgtgggcggcaacacgattcaaacactgaacctgtcaagcagttggcaagattttactgtcaataccgatgcctcgggcgatattaacgtagagctgtttaatgaccagggtcagggctatgaggcgcgtattgattatgtgctggttaatggcgagacccgctacgcggctgaccagagttataacaccagcgcctgggatggcgaatgcgggggtggctcttttacccaatggatgcattgtgatggcatgattggttttggtgatatgtcgggtggtggttctgctgtgggtacaagcagtagcggtaatgccggcagcaataccagcagtgcctgttactgtaattggtatggcagtgtgatggcttcttgtgaaaatcaggtgaacggctggggttgggaaaataatcaaagctgtattggtaataatacctgtaataatcagggcggtagcggaggcgtggtgtgcaattaa

SEQ ID NO: 262 - protein, 542 aa, Unknown
  Obtained from an environmental sample.
  SIGNAL (1)...(26)
MINKIGKGFFSAFICAAALSVSTVNAQQTVTTNTQGTHDGFFYSFWKDSGDASFGLREGGRYTSQWNTSTNNWVGGKGWNPGGRRVVHYQGQYNVDNSQNSYLALYGWTRSPLIEYYVIESYGSYNPSNCTQGRQTYGTFQSDGATYEIVRCQRVQQPSIDGTQTFYQYFSVRQPKKGFGSISGTITVGNHFDAWAAAGLNLGEHDYMVMATEGYQSTGSSDITVSEITGGSGGGSSSGANTLVIRAVGTSGNELLRVNVGGSPVQTLSLSTSWQDFTVNTDATGDINVELFNDQGQGYEARIDYVLVNGETRYAADQSYNTSAWDGECGGGSFTQWMHCDGMIGFGDMTGGNAGGGGSSGGSGANTLVVRAVGTSGNEQLRVNVGGNTIQTLNLSSSWQDFTVNTDASGDINVELFNDQGQGYEARIDYVLVNGETRYAADQSYNTSAWDGECGGGSFTQWMHCDGMIGFGDMSGGGSAVGTSSSGNAGSNTSSACYCNWYGSVMASCENQVNGWGWENNQSCIGNNTCNNQGGSGGVVCN

SEQ ID NO: 263 - DNA, 1092 bp, Unknown
  Obtained from an environmental sample.
atgaaaactaatcacccatttaaattcgggaaaaaaatatgtatggcattggctttgctggtgcttggcatacaggcttcaatcgcacaggaaatttgtattaccagcggcactgaccagatcagagaaaccacatccaacggctatacccacgaactatggaatcaggacacccgggggacggcctgtatgactattaatgcaggcaccacttacagtgcgcggtggaacggtgcatttaactatttggcccgccgtggattggcctacgatggttcgtccctcacccatgctgaccgggggaaattcaccataaattatgcctctaactacaactgcaacaatatgaatgggctctcttatttaagcgtgtacggatggacgcgggattttgccaaggaaaatgccaatccggcaggatcacaggctcatcaggaagcgctggtggaatattacattgttgaaaactggtgcgactggaatgtttcacaagaccctaacgcccagagtctgggcaccctgaatgttgatgggtcgatctatgatatgtatcgcacagaacggatcaaccaaccttctatcaggtgcggtggtacctgcgataatttttaccaatacttcagcattcgccgcaacacacgtaacagtggcaccattgatgtcagcgctcatttcaaccagtgggaagcattaaccggcgtccctatgggtggcctgcacgaagtgatgatgaaggtcgaaggctacaactcaaacaatcaatccagtggcaatgtaagctttactcaattgctcatgcgtgcccgcttcgaggatggcgccattgtcgagaaccagaatgcggtcggccatgcgcacggtggagaagcggtgggagatgatcaccgccgtcttgccctgggccaggcccttgaagcgggcgaacacctcggcctcggccttggcgtcgagggcggcggtgggttcgtcgagaatgatcaactcggcgtcgcgcatataggcgcgggcgatggctaccttctgccactcgccgcccgagaggtcgcggccctgcttgaaaaggcgccccaattgctccagagaaacgggtga

SEQ ID NO: 264 - protein, 363 aa, Unknown
  Obtained from an environmental sample.
  SIGNAL (1)...(29)
MKTNHPFKFGKKICMALALLVLGIQASIAQEICITSGTDQIRETTSNGYTHELWNQDTRGTACMTINAGTTYSARWNGAFNYLARRGLAYDGSSLTHADRGKFTINYASNYNCNNMNGLSYLSVYGWTRDFAKENANPAGSQAHQEALVEYYIVENWCDWNVSQDPNAQSLGTLNVDGSIYDMYRTERINQPSIRCGGTCDNFYQYFSIRRNTRNSGTIDVSAHFNQWEALTGVPMGGLHEVMMKVEGYNSNNQSSGNVSFTQLLMRARFEDGAIVENQNAVGHAHGGEAVGDDHRRLALGQALEAGEHLGLGLGVEGGGGFVENDQLGVAHIGAGDGYLLPLAAREVAALLEKAPQLLQRNG

SEQ ID NO: 265 - DNA, 996 bp, Unknown; identical to SEQ ID NO: 49
  Obtained from an environmental sample.

SEQ ID NO: 266 - protein, 331 aa, Unknown; identical to SEQ ID NO: 50
  Obtained from an environmental sample.

SEQ ID NO: 267 - DNA, 1956 bp, Unknown
  misc_feature: Bacterial DNA
atgaagcgtaaggttaagaagatggcagctatggcaacgagtataattatggctatcatgatcatcctacatagtataccagtactcgccgggcgaataatttacgacaatgagacaggcacacatggaggctacgactatgagctctggaaagactacggaaatacgattatggaacttaacgacggtggtacttttagttgtcaatggagtaatatcggtaatgcactatttagaaaagggagaaaatttaattccgacaaaacctatcaagaattaggagatatagtagttgaatatggctgtgattacaatccaaacggaaattcctatttgtgtgtttacggttggacaagaaatccactggttgaatattacattgtagaaagctggggcagctggcgtccacctggagcaacacccaaaggaaccatcacagtggatggcggtacttatgaaatatatgaaactacccgggtaaatcagccttccatcgatggaactgcgacattccaacaatattggagtgttcgtacatccaagagaacaagcggaacaatatctgtcactgaacattttaaacagtgggaaagaatgggcatgcgaatgggtaagatgtatgaagttgctcttaccgttgaaggttatcagagcagtgggtacgctaatgtatataagaatgaaatcagaataggtgcaaatccaactcctgccccatctcaaagcccaattagaagagatgcattttcaataatcgaagcggaagaatataacagcacaaattcctccactttacaagtgattggaacgccaaataatggcagaggaattggttatattgaaaatggtaataccgtaacttacagcaatatagattttggtagtggtgcaacagggttctctgcaactgttgcaacggaggttaatacctcaattcaaatccgttctgacagtcctatcggaactctacttggtaccttatatgtaagttctaccggcagctggaatacatatcaaaccgtatctacaaacatcagcaaaattaccggcgttcatgatattgtattggtattctcaggtccagtcaatgtggacaacttcatatttagcagaagttcaccagtgcctgcacctggtgataacacaagagacgcatattctatcattcaggccgaggattatgacagcagttatggccccaaccttcaaatctttagcttaccaggcggtggcagcgccattggctatattgaaaatggttattccactacctataataacgttaatttcgccaacggcttaagttctataacagcaagagttgccactcagatctcaacttccattcaggtgagagcaggaggagcaaccggtactttacttggtacaatatatgttccttcgacaaatagttgggattcttatcagaatgtaactgccaaccttagcaatattacaggtgtgcatgatattacccttgtcttttcaggaccagtgaatgtggactacttcgtatttacaccagcaaatgtaaattcagggcctacctcccctgtcggaggtacaagaagtgcattttccaatattcaagccgaagattatgacagcagttatggtcccaaccttcaaatctttagcttaccaggtggtggcagcgccattggctatattgaaaatggttattccactacctataaaaatattgattttggtgacggcgcaacgtccgtaacagcaagagtagctacccagaatgctactaccattcaggtaagattgggaagtccatcgggtacattacttggaacaatttacgtggggtccacaggaagctttgatacttatagggatgtatccgctaccattagtaatactgcgggtgtaaaagatattgttcttgtattttcaggtcctgttaatgttgactggtttgtattctcaaaatcaggaacttaa

SEQ ID NO: 268 - protein, 651 aa, Unknown
  DOMAIN (1)...(651): Bacterial protein
  SIGNAL (1)...(30)
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITVDGGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPIGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYNNVNFANGLSSITARVATQISTSIQVRAGGATGTLLGTIYVPSTNSWDSYQNVTANLSNITGVHDITLVFSGPVNVDYFVFTPANVNSGPTSPVGGTRSAFSNIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 269 - DNA, 1110 bp, Unknown
  Obtained from an environmental sample.
atggggtacaataggatcatacaagcgatccgcgtaagcaagggagatgttttgggcgttcataaagttttttacgctgcacttgcgtgtgtggcgatggggtattcggaaacgtgggcacagtgcgcgacctggacccgaagcaccattcgcaattgcgagggcatcgactacgagttgtggaaccagaacaaccgcggcacggtcaacatggaaatcacgggaaacggaacgttcgcggcgacgtggagcggaacggaaaacatcctgtttcgcgccggcaagaaatgggggttcaacagcaccacgacggcgcggtcggtcggcgccatcacgctcgatttcgctgcgacctggacctccagcgacaacgtgaaaatgctcggcatctacggctgggcgtattacccgtcgggaagcgagccgacgaaaacggaaagcggtcaaaacacgagcttttccgatcagatcgagtattacatcatccaggaccgcggaggcttcaacccgggttccggcggcgtcaacgccaaaaagtacggcgaggccgtgatcgacggaatcgcctatgacttttgggtggccgaccggatcaaccagcccatgctgacaggaagaggcaacttcaagcaatacttcagcgttccacggaacacgagcagccaccggcaaagcggcatcgtcagcatttcgaagcactttgaggagtgggacaaggccggcatgaagatgctggactgtccgctatacgaagtcgcgatgaaggtggaatcgtatacgggctcggcgaatggcggcgggtcggcgaacgtgacccggaatattctcacgctcggcggttcttccgcaccgacccctatcgcgcgcggccccggccggtccgccgaaagcatgcgggtcgccttcgttcaggaaagagtgctcaaggtcgcgcccgtcgacggaacccgcctgcaagtcaaggtgcgggacgtgaagggcgtgaaccgggccgagttcaatgccgcgggcgcggcaacgttctcgttgtcccatgtccccgcgggcccgtatttcctggatgtgacggggccggatgtaagacagatcacgccgttcgttttgcgataa

SEQ ID NO: 270 - protein, 369 aa, Unknown
  Obtained from an environmental sample.
MGYNRIIQAIRVSKGDVLGVHKVFYAALACVAMGYSETWAQCATWTRSTIRNCEGIDYELWNQNNRGTVNMEITGNGTFAATWSGTENILFRAGKKWGFNSTTTARSVGAITLDFAATWTSSDNVKMLGIYGWAYYPSGSEPTKTESGQNTSFSDQIEYYIIQDRGGFNPGSGGVNAKKYGEAVIDGIAYDFWVADRINQPMLTGRGNFKQYFSVPRNTSSHRQSGIVSISKHFEEWDKAGMKMLDCPLYEVAMKVESYTGSANGGGSANVTRNILTLGGSSAPTPIARGPGRSAESMRVAFVQERVLKVAPVDGTRLQVKVRDVKGVNRAEFNAAGAATFSLSHVPAGPYFLDVTGPDVRQITPFVLR

SEQ ID NO: 271 - DNA, 1128 bp, Unknown
  Obtained from an environmental sample.
atgttcattcacaacagcatatgcagcgcactctgcacaatctttttggcaactgcaacaatgggagaaaacatgacactacaagaagcctttgccgatcacttttatgtgggagccgccatcagccaacgcctttttcaaccagatcgcgccgaaacgctgcaactggccgcgcaccaattcaacagcatcacagccgaaaatgagatgaagtggcagtcgttaaatcccactcctggcgaataccgtttcgaaaacgccgataaattcgtccgctttggtgtcgaaaacgatatgtacatcgttgggcacgttctcttctggcacagccagacacccgactggctcttcaaggatgacgacggtaacttcgtctcccgcgaagtcttactcgaccgcatgcgcgcccacgtgcgcaatcttgtccagcgctacggcaaccatgtgcacgcctgggatgttatcaatgaaaccttcaatgataatggttccttgcgcgacagcccatggacgcaaatcctcggcgaggaattcatcgagcacgccttccggattgccggcgaggaactccccccccatgtcgagctgctctacaatgattattcgatgaccattcctgccaagcgcgatgctgttgctgaaatggttcgcgacctcatagccaaaggcatccgcattgacggcgttggcatgcagggacattgggcacggacccacccgaccatagcggacatagaaaaaagcattcttgccttcgcaggaaccggcgtacaggtacacatcactgagctcgacatcgacatgctgccacgccatccccagatgtttactggtggtgcagacaccatgttgcgcctacaacaagatcccaaactcgacccctacactgagggacttccagcggaagatcagcaggcattggcagaacgctacgcaagcatcttccgtttattcttgaagcacagcgatgttattcgccgtgtcaccttctggggggtcaccgatgcccacacctggctcaacaattggcccatccgtggccgcaccagccatcccctgctcttcgaccgccagaacaaccccaaacccgccttccacgccgtcgtcagactgaagaccgaagactga

SEQ ID NO: 272 - protein, 375 aa, Unknown
  Obtained from an environmental sample.
  SIGNAL (1)...(22)
MFIHNSICSALCTIFLATATMGENMTLQEAFADHFYVGAAISQRLFQPDRAETLQLAAHQFNSITAENEMKWQSLNPTPGEYRFENADKFVRFGVENDMYIVGHVLFWHSQTPDWLFKDDDGNFVSREVLLDRMRAHVRNLVQRYGNHVHAWDVINETFNDNGSLRDSPWTQILGEEFIEHAFRIAGEELPPHVELLYNDYSMTIPAKRDAVAEMVRDLIAKGIRIDGVGMQGHWARTHPTIADIEKSILAFAGTGVQVHITELDIDMLPRHPQMFTGGADTMLRLQQDPKLDPYTEGLPAEDQQALAERYASIFRLFLKHSDVIRRVTFWGVTDAHTWLNNWPIRGRTSHPLLFDRQNNPKPAFHAVVRLKTED

SEQ ID NO: 273 - DNA, 1134 bp, Unknown
  Obtained from an environmental sample.
atggtttcatcgctaatcaattcttcatacattcggctcaagcactattcgtgctcaagtttattgctcctgacattggcagcctgtggcggccagcagcctcccccggatacgggatccagcacttcaagttcaagcagttcttcgagctccagttcaagcagctcttcaagttccagctcaagcagttcttccagctccagctcgagcagctcttcgagttcgagctcttcatcatccagctcttcaggggcaaacccgccaccgaccgggggcaagttcgtcggcaacatcacgacccgaggcgccgtccaagcggacttcattcagtactgggatcaaattacgccggagaacgagggcaaatggggttctgtggaaggaactcgcgaccagtacaactgggcgcctcttgatcgcatctatgactatgcacgtcagcacaatatcccagtcaaagcgcatacgctggtttggggtgcacaggctccaggctggatcaacaatctgagtgcggccgagcagcgtgaggaaatcgaggaatggattcgtgattactgcacgcgttacccagacacccaaatgatcgacgtagttaacgaggcgcacccaaatcacgcccccgctcgctatgcgcagaatgccttcggcaatgactggattaccgaagcgttcaaactggcgcgccggcactgccccaacgccattttgatctacaacgactataatttcatcacttgggataccgatgaaatcatggcgctgattcgcccggctatcgcagcaggggtagtggatgcggtagggctgcaggcgcatagcttgtatcctgacgaatacgctaacaagatgtggagtgccgctgaaatacagcagaagctcgatctgatctctacccttggcgtgccgatgtatatttcggaatatgatgtcgccaagtccaatgaccaagagcagttggcgattttcagcgagcagttcccggtcctttacgaacaccccaatgtcgtaggtgtaaccctctggggctatattgatggagcgacgtggcgcgccggctcgggcttgattcgaaacggtcagcaccggcccgccatgcaatggctgctcgagtacttggagaacaatcgatag

SEQ ID NO: 274 - protein, 377 aa, Unknown
  Obtained from an environmental sample.
  SIGNAL (1)...(74)
MVSSLINSSYIRLKHYSCSSLLLLTLAACGGQQPPPDTGSSTSSSSSSSSSSSSSSSSSSSSSSSSSSSSSSSSSSSSSSSSSGANPPPTGGKFVGNITTRGAVQADFIQYWDQITPENEGKWGSVEGTRDQYNWAPLDRIYDYARQHNIPVKAHTLVWGAQAPGWINNLSAAEQREEIEEWIRDYCTRYPDTQMIDVVNEAHPNHAPARYAQNAFGNDWITEAFKLARRHCPNAILIYNDYNFITWDTDEIMALIRPAIAAGVVDAVGLQAHSLYPDEYANKMWSAAEIQQKLDLISTLGVPMYISEYDVAKSNDQEQLAIFSEQFPVLYEHPNVVGVTLWGYIDGATWRAGSGLIRNGQHRPAMQWLLEYLENNR

SEQ ID NO: 275 - DNA, 1401 bp, Unknown
  Obtained from an environmental sample.
ttgggcgctgatccatttgcgctcacctataacggaagagtgtacatttatatgtcgagtgatgactatgaatatcacagcaatggaacgattaaggataattcttttgccaatttgaatagggtctttgtcatctcttcagcagatatggtgaactggacagatcatggcgcgattccagtagctggggcaaatggcgcaaatggcggcaaaggaattgccaaatgggcaggtgcttcctgggctccatcagcagcggtgaaaaaaatcaatgggaaggataaatttttcctttatttcgcgaacagcggcggagggattggcgttctgacagcagactcccccatcggtccatggacagatcctatcggaaaagcactcgtcacgccaaatacaccagggatggctggagttgtatggctttttgatcctgccgtttttgtagatgatgacggcactggttatctatatgccggcggaggtgttccaggcggttctaatccaacgcagggacaatgggcgaatcctaaaacagcaagagttctaaaactaggacctgatatgacaagtgtggtaggcagcgcatcaaccattgatgctccttttatgtttgaagattcggggatgcataagtataacggaacctattactattcctattgcatcaactttggcggctcccacccagcagataaaccacctggtgagatcggttatatgacgagctcaagtccgatgggtccctttacgtatagagggcacttcctgaaaaatccgggtgcatttttcgggggaggcggtaataaccatcatgctgtgttcaattttaaaaacgagtggtatgtcgtgtatcatacccaaacggtcagctctgctttatacggatcaggaaaaggctacagatctccgcatattaataaacttgtgcataatgctgacggctcccttcgagaagtcgcagccaattttgaaggggttaaacagctttccaacctgaatccttatcagcgtgtagaagctgaaacattcgcatggaatggacgcattttgacagaggcatcttcagctccaggcggaccggtcaataaccagcatgtcacaaacattcaaaacggagattgggtggctgccagtaacgtcgatttcggatcaaacggcgcgaggacatttaaagcgaatgtagcatcaaatacaggcgggaaaatagaagtacgcctcggaagtccagacggcagactcgtcggaacactgaatgtcccttccacagggggaacaaataactggcgagaagtagaaacggcagtaaatggagcagcaggcgtgcacaacgtattttttgtttttactggaacaggtgcaaatctatttcaatttgattcctggcagtttactcaaaggtaa

SEQ ID NO: 276 - protein, 466 aa, Unknown
  Obtained from an environmental sample.
MGADPFALTYNGRVYIYMSSDDYEYHSNGTIKDNSFANLNRVFVISSADMVNWTDHGAIPVAGANGANGGKGIAKWAGASWAPSAAVKKINGKDKFFLYFANSGGGIGVLTADSPIGPWTDPIGKALVTPNTPGMAGVVWLFDPAVFVDDDGTGYLYAGGGVPGGSNPTQGQWANPKTARVLKLGPDMTSVVGSASTIDAPFMFEDSGMHKYNGTYYYSYCINFGGSHPADKPPGEIGYMTSSSPMGPFTYRGHFLKNPGAFFGGGGNNHHAVFNFKNEWYVVYHTQTVSSALYGSGKGYRSPHINKLVHNADGSLREVAANFEGVKQLSNLNPYQRVEAETFAWNGRILTEASSAPGGPVNNQHVTNIQNGDWVAASNVDFGSNGARTFKANVASNTGGKIEVRLGSPDGRLVGTLNVPSTGGTNNWREVETAVNGAAGVHNVFFVFTGTGANLFQFDSWQFTQR

SEQ ID NO: 277 - DNA, 1128 bp, Unknown
  Obtained from an environmental sample.
atgcgaaacacattaatccttttgattccggccttgatgatgctttcttgcagtgcgggaaatcaggatagagtaccatccctgcacgccgagttctcggatgcatttttgattggaacggcgctgaattctgagcagatattgggtcgggatacacgcggactcgaattgattagaactcattttaacgccattacgcccgaaaacattaccaaatgggaggctatccatcccgaacccggtgtctatgattttaaagaggctgatgcattcgtcgattttggccaaaaatataatatgttcatggtgggtcatacactggtttggcatagtcagacaccgcgctgggtcttcaaagacgaaaatggcgcgttggtatcgcgcgaggtactgttagagcggatgcgcgaccacatccacaccgttgttggccgctaccgtggacgtattcacggctgggatgtcgtaaacgaagccctcaatgaagacggttcgtacagagaaacactgtggtaccaaataattggtacggactatattcttaaagcattcgaatttgcccgggaggccgatcccgacgctgagctatactataacgattactcgcttgagaacccctcaaagagagccggcgcgatgcgaattgttcaatacctgcaggaacatggtgctccgattactggggttggaacccaggggcatttcaccctcgactggcccgaactttctgaaattgaacagaccgtcattgattttgcctcccttggtatggatgtaatgattaccgaattggatatcgatgtactgcctcagccagacgattatactggcgccgatgtgaattttagcgcagagctttacgacgaactgaacccatggcccaacggccttccaccggaaattgaacaggaattggccaatcgatatgccgacatcttcgaaatctatttgcgtcatcgtgataaagttacgcgagtgtctttttggggtgtcacagatggcgactcgtggaaaaataactggcctgtgccaggtcgtaccaactatccgctcatttttgatcgaaactggaagccaaaacccgcttttttctcgattgttgatgcagccagggaggcactggattaa

SEQ ID NO: 278 - protein, 375 aa, Unknown
  Obtained from an environmental sample.
  SIGNAL (1)...(19)
MRNTLILLIPALMMLSCSAGNQDRVPSLHAEFSDAFLIGTALNSEQILGRDTRGLELIRTHFNAITPENITKWEAIHPEPGVYDFKEADAFVDFGQKYNMFMVGHTLVWHSQTPRWVFKDENGALVSREVLLERMRDHIHTVVGRYRGRIHGWDVVNEALNEDGSYRETLWYQIIGTDYILKAFEFAREADPDAELYYNDYSLENPSKRAGAMRIVQYLQEHGAPITGVGTQGHFTLDWPELSEIEQTVIDFASLGMDVMITELDIDVLPQPDDYTGADVNFSAELYDELNPWPNGLPPEIEQELANRYADIFEIYLRHRDKVTRVSFWGVTDGDSWKNNWPVPGRTNYPLIFDRNWKPKPAFFSIVDAAREALD

SEQ ID NO: 279 - DNA, 786 bp, Unknown
  Obtained from an environmental sample.
atgctttctccgacaaggaaactcccgccggccattggactcaccttcctcttcgccgcttcggcgacgccggaaaccacgctcaaggacgccttcgcggaccattttctcgtcggggcggcgctcaatgaatcgcactttgcggagcacaatccggcgcacgccggtctcgtcgccgcaaacttcaatgcgatcaccgcggagaatgtgatgaaatgggaggccgttcatccccggccgggagaatatacgttcggcgccgcggaccggttcgttgagttcggggaaaagaacggcctgttcatcgtggggcacacgctgatctggcattctcaaacgccggcctgggttttcgaggatgagaatggcgcgccgctcggccgcgaggcgctgctggagcggatgcgcgatcacattcacaccgttgccggacgttacaggggccgtgtgaaggggtgggacgtggtcaacgaagccctcgccgaggacggttccctgcgggattcgccgtggcgccgcatcataggcgacgactatttcgtgaaggcctttgagtttgcgcgggaagctgatccggatgcggagttgtattacaacgattactcgattgaaaacgaaccgaagcgcaagggggcggtggcgttggtgaggacgctccaggcggcgggtgttcccgttgccggcgtggggattcagggacacggcaatctccattggccttctccgcggcttgtcgaagaggcgatccgggactttgccagtttgggcgtcaaggtgatgatctga

SEQ ID NO: 280 - protein, 261 aa, Unknown
  Obtained from an environmental sample.
  SIGNAL (1)...(22)
MLSPTRKLPPAIGLTFLFAASATPETTLKDAFADHFLVGAALNESHFAEHNPAHAGLVAANFNAITAENVMKWEAVHPRPGEYTFGAADRFVEFGEKNGLFIVGHTLIWHSQTPAWVFEDENGAPLGREALLERMRDHIHTVAGRYRGRVKGWDVVNEALAEDGSLRDSPWRRIIGDDYFVKAFEFAREADPDAELYYNDYSIENEPKRKGAVALVRTLQAAGVPVAGVGIQGHGNLHWPSPRLVEEAIRDFASLGVKVMI

SEQ ID NO: 281 - DNA, 963 bp, Unknown
  Obtained from an environmental sample.
gtgggcacctgcatgagcggggccgattcgcgcaaccctgcccgtctggagctgatcagaacgcagtacagcatcatcaccccggaaaacgagctcaagcccgattccgttctggatgtggctgccagccgtgctctggccaaggaggacgataccgccgtggccgtgcatttcagcgccgccgctcccatcctgaactttgcccgtgacaacggcatcaaggtgcacggtcatgtgctggtctggcacagccagactcccgaggagttcttccacgagggctataacgcctccgcgccctatgtgagccgcgaggtgatgctggcccgtctggacaactacatccgtctcatctttgaatatatggatgaaaactatcccggcctgatcgtgtcctgggatgtggccaacgaatgcgtggccgacggctccaccgccctgcgcacctccaactggacccgcgtggtggggcaggattttgtggcccgcgccttcgagatcgccgataaatacgcgcccgaagatgtgatgctctgctacaacgattattccactccctatgagcccaagctcaccggcatcgtgaacctgctcaccgagctgacacaggagggtcatatcgacggctacggcttccagagccactacagtgtcggcgatccctccctgcaggcggtcgagaacgcgttcaaaaagatctccgccctggggctcaagctgcgcgtgagcgagctggacatcaaggtagatgccgacagcgagcccaaccgcgcccttcaggccgaccggtatgaggccctgctgcgcatctatatgaaatacggcgtcagcgccgtgcaggtgtggggcgtatgcgacggcaccagctggatcggcgcgagctatcccctcccctttgacgccgggctgcgtcccaagccctccttcttcggcatactccgcgcccttgacgaacagaactga

SEQ ID NO: 282 - protein, 320 aa, Unknown
  Obtained from an environmental sample.
MGTCMSGADSRNPARLELIRTQYSIITPENELKPDSVLDVAASRALAKEDDTAVAVHFSAAAPILNFARDNGIKVHGHVLVWHSQTPEEFFHEGYNASAPYVSREVMLARLDNYIRLIFEYMDENYPGLIVSWDVANECVADGSTALRTSNWTRVVGQDFVARAFEIADKYAPEDVMLCYNDYSTPYEPKLTGIVNLLTELTQEGHIDGYGFQSHYSVGDPSLQAVENAFKKISALGLKLRVSELDIKVDADSEPNRALQADRYEALLRIYMKYGVSAVQVWGVCDGTSWIGASYPLPFDAGLRPKPSFFGILRALDEQN

SEQ ID NO: 283 - DNA, 4161 bp, Unknown
  Obtained from an environmental sample.
atgtataaaagtttcgtcaagaaagtctcccttgtattatctactcttttgctcttagtttcggcgtttcctgtctcatatgcacaaatgaattccatccccgtttatgaagaaacgtttgaaaaccaaggaaactatgtccaatctggtggtgcgaccctcactctagtaaaaaacaaagtgtttgcagggaatgaagatggaactgcactatatattagtaatcgatcgaataactgggacggggcagatttccgtttcacggatcttggattacaagatggaaaaacatatacgatcaatattataggatatgtcgatgaaaatgaagttgttccttcaggagcccaagtgtatttgcaaactgtagataaaacatatggatggttagcaagcgcggacttaaaaaacggagagtcgttcactataaatacaacgttcacccttgacatgagtaaaggggacacccgtcttcgtatacaatccaacgatagtggtaaaaaagtttcattttacgtcgggtatttttcaatttcaattagtgatgtagaaggagaagatggtgggagctctatttcaaggccaccggctttaccttttgaaactattgactttgaagatcaaagtttaagtggatttgagggacgagcaggcacggaaacattgaccgttacgaatgaagcaaatagaactcctggaggatcttatgcactaaaagtggaaaatagatctcaaaattggcatggaccttccttacgcatcgagaaatatattgatttaggttacgaatatacaatttctctatgggttaaacttatttcacccacaagtgcacaaattcagctttctacccaagtcggaagtggaagtggtgcgagttataacaatattttaagtaaagtaattagtgttgatgatggatgggtactgtatgaaggaaagtatcgctacaatagttcgggaggggaatatttaacaatttacgtagaaagcccaaacaatagtactgcatctttttacatcgatgatattcgtttaataaagagtggagacccaatctctgtacaaaaagatcttctccctatcaagagtgtttatgaaggtgacttcttagttggtagtgccgtatcagcgactgatttagagggagagagactcgagcttctcaagttgcattacaatagcataacagcggaaaacgccatgaaacctagctatttacaacctactaaaggaaactttaccttcgaagcagcagatagtattgtaaataaagccctagaagaaggaatgaaagtacatggacatgttctcgtatggcatcagcagacacctgaatggatgaccactagagaagatggaagccctctcggcagggaagaagcgttagaaaatctaaaaaatcacattgaaacagttatgaaacattttggtgatagagtaatttcatgggatgttgtcaatgaagctatcattgataatccacctaatcctgataattgggaggaatcattaagaaaatcaccatggtactattcaatcggttctgattatgttgagcaagcattccgaattgcacgacaagttttggacgaaaatgggtgggatattaagctatattacaatgattacaatgaagataatcaaagaaaagcacaagccatttaccatatggtaaaagagcttaatgaaaaatatgcacaagagcatcctggtaaaagattaatcgatggaattggaatgcaagggcattacagtatacgaacaaatccagataatgtgaaaatgtcattagaaagatttatttcccttggtgtggaagttagtattactgaactcgatattcaagctggaacggataatcatcttacggaagaacagtcaaaagcacaagcatatttatacgctaaattattcaaaatattcaaagaaaatgcatcgcatatctcccgagttacgttatggggattaaatgatgcggcaagttggcgtgcgtcaacaagtccattgttatttgatcgaaatttacaggccaaaccaagttactatgcggtaattgatcctgatacatttatagaagaaaatcctactgtgacagaagagtcgcggaaagcaattgctttgtatggtatccctgtaattgatggaagcatcgattccatttgggaaagtgttccttacatccctattgatcgttaccaaatggcgtggcaaggagcaagcggaactgctaaagttctttgggacgaagggaatctgtatgtattagtacaagttaacgatgaccagttagataagtcgagtacaaatccttgggagcaggattcgatagaggtgtttgtggacgaaaataatgcaaaaacatcgttttaccaagaggatgatggacaatatagagtaaactttgacaacgaaacatcgtttaatccaccaagcattgaaaatggatttatgtccgaaactaatgtatctgggactaattatgtggtggagatgaaaatccctttaagaagtatacaactaaaaaatgggtctgaaatagggtttgatgttcaaattaatgatgggaaaaatggtgctcgtcagagtgtggctgcttggaatgatacgactggaactgcatatatggatacatctgtattcgggacacttactcttttaaccactttagataatgaaaatacaccaggcagcggcacaacaccaggtagtggcacaacaccaggcagtggcacaacaccaggcagcagcacaacaccaggcagcggtacaacaccaggtagcggcacaacaccaggcagtggcacaacaccaggcagcggcacaacaccaggcagtggcacaacaccaggcagtggcacaacaccgggcagcggtacaacaccaggcagtggcacaacaccaggcagtggtacaacaccgggcagtggcacaacaccagtgaagggtgaaaatggtacggttgttttacagccgaaagtagagacgaaagaaaaagacggcaaagtagtagaaaaagtggcaactatttcaacaaatgaagttgaagcgattgtcaaggagctgtcgaatgaaaataaacaagtcgtcgtctccctcggctcgcttccaaaaggtgtagccacaaaagtagatgtgccagctacattatttacacaagcggcaaataaacaagcagaagcaacgattgtgagcgccagtgaacaagcgacgtacaaattgccagtcaaagaagtgcaggcgtctcttgcgacgattgcccggtcactcggtgcaacgatagaacaagttagcatctcgattgaaatgaaagtgaacgatgcgccgtcactacgtgtgaaaccgttgtctgatgcggtagagtttcatgtcgtggcgaaagcaaatggaaaggaacgcgtcatcgatcggtttactcaatatgtcgaacgcgaaatcgcgttaaagcaatcggtcaacgctagtcgtgccattgcagtgcgcgtgaacgatgacggttcacttaccccagtaccgacaacgtttgttggcaacaaagcagtcattaaatcgttgacgaactcgacgtatgttgttgtggaaggaacacatacatttagtgacatccaaccacattgggcgaaaggttatattgaaacactcgcggcaaaacagcttgtcaaagggatgacggacacaacatatcgaccaaatgatcggatgacgcgcgcgcaatttgcggtgttgctcgtacgggcgctaggattgccgagcgaaacgtatgacggtcgctttgctgatgtgaagggaacggagtggtttaacaagaacggtgaattagcagcggcagtcaagttcggaatcattcaaggaaaaacagcttatatgtttgcgccgaatgagccaatcactcgcgcacaagcagctgtcatgatcgaacgggcattgaaactttcgatcgttggctatgatgaggcaacaagcgacaaaacgaaaaaagtgacagatttccgcgatgcaaaacaattgccaacatgggcaaaacaggcgattgaagcagtataccaagcaggcatcatgcaaggacgagatagcggaaactttgatccgacaagccatgtgacgcgtgccgaaatggcgaaggtgttaatggatattttagagttgacaaaacttatttaa

SEQ ID NO: 284 - protein, 1386 aa, Unknown
  Obtained from an environmental sample.
  SIGNAL (1)...(28)
MYKSFVKKVSLVLSTLLLLVSAFPVSYAQMNSIPVYEETFENQGNYVQSGGATLTLVKNKVFAGNEDGTALYISNRSNNWDGADFRFTDLGLQDGKTYTINIIGYVDENEVVPSGAQVYLQTVDKTYGWLASADLKNGESFTINTTFTLDMSKGDTRLRIQSNDSGKKVSFYVGYFSISISDVEGEDGGSSISRPPALPFETIDFEDQSLSGFEGRAGTETLTVTNEANRTPGGSYALKVENRSQNWHGPSLRIEKYIDLGYEYTISLWVKLISPTSAQIQLSTQVGSGSGASYNNILSKVISVDDGWVLYEGKYRYNSSGGEYLTIYVESPNNSTASFYIDDIRLIKSGDPISVQKDLLPIKSVYEGDFLVGSAVSATDLEGERLELLKLHYNSITAENAMKPSYLQPTKGNFTFEAADSIVNKALEEGMKVHGHVLVWHQQTPEWMTTREDGSPLGREEALENLKNHIETVMKHFGDRVISWDVVNEAIIDNPPNPDNWEESLRKSPWYYSIGSDYVEQAFRIARQVLDENGWDIKLYYNDYNEDNQRKAQAIYHMVKELNEKYAQEHPGKRLIDGIGMQGHYSIRTNPDNVKMSLERFISLGVEVSITELDIQAGTDNHLTEEQSKAQAYLYAKLFKIFKENASHISRVTLWGLNDAASWRASTSPLLFDRNLQAKPSYYAVIDPDTFIEENPTVTEESRKAIALYGIPVIDGSIDSIWESVPYIPIDRYQMAWQGASGTAKVLWDEGNLYVLVQVNDDQLDKSSTNPWEQDSIEVFVDENNAKTSFYQEDDGQYRVNFDNETSFNPPSIENGFMSETNVSGTNYVVEMKIPLRSIQLKNGSEIGFDVQINDGKNGARQSVAAWNDTTGTAYMDTSVFGTLTLLTTLDNENTPGSGTTPGSGTTPGSGTTPGSSTTPGSGTTPGSGTTPGSGTTPGSGTTPGSGTTPGSGTTPGSGTTPGSGTTPGSGTTPGSGTTPVKGENGTVVLQPKVETKEKDGKVVEKVATISTNEVEAIVKELSNENKQVVVSLGSLPKGVATKVDVPATLFTQAANKQAEATIVSASEQATYKLPVKEVQASLATIARSLGATIEQVSISIEMKVNDAPSLRVKPLSDAVEFHVVAKANGKERVIDRFTQYVEREIALKQSVNASRAIAVRVNDDGSLTPVPTTFVGNKAVIKSLTNSTYVVVEGTHTFSDIQPHWAKGYIETLAAKQLVKGMTDTTYRPNDRMTRAQFAVLLVRALGLPSETYDGRFADVKGTEWFNKNGELAAAVKFGIIQGKTAYMFAPNEPITRAQAAVMIERALKLSIVGYDEATSDKTKKVTDFRDAKQLPTWAKQAIEAVYQAGIMQGRDSGNFDPTSHVTRAEMAKVLMDILELTKLI

SEQ ID NO: 285 - DNA, 1569 bp, Unknown
  Obtained from an environmental sample.
gtgaaccgaaacacatctccggacttcaagcttggagcaggcgttacggtaagtgatttcctgaacaagggcaggcaatatgaggtcgctgtggcgaatcttgatgaaatgacggccggaaatgccatgaagcagtcttctgtaatgaggcctgacggatccatggatttcactcaggtcagaagattcatcgaggaggccgaacgtgtcggaatgacagtgtacggccatacattggcatggcattcacagcagcagaacgcctatcttaacggtctgatcaagggcaagaagaccgaggtcgagccaggccaggagtcagaggtcgttcttctccagacagatttcaatgacggaaatgtcacattcaacggatggggaaacaattcttcaaggactgtcgagaatggtgcattaaagcttacaaacccttctgtagtaaacagttgggaggcccagttcgcatatgatttttcagaggccttcgagatggacaagacatataagctcaagttcaggatcaagggctcggctgcaggaaagatcgcggcaggcttccagatcactgacggctacctttcggcaggtgagttcggaaccgtagagttcaatacccagtggaaggatgtcgagctctcatgcgtatgttccgctgaaggcggtacacgcttgatcttcagtttcggagagtttgccggagatatctatatcgacgatttctgcttcagtgtggaaggagctggatatatctacgaagatcttaccccggcagagaagaaggagcgccttaccgaggcaatggaccgttggatcaagggaatgatggaggttaccgctaccagggtttctgcgtgggatgctgtcaatgaggcgatttccggccgtgatacaaatggcgacggcttctatgaacttgagtcggcacaatggggaagctcgaacaacttctattggcaggattatctcggctcaggagattatgtgcgtatcgtgatcgcaaaggcccgcaagtattatgaggaattcggcggtacggctcctttgagactcttcatcaatgactacaacctcgaatctgactgggatgacaacaagaagctcaagagccttatccattggatcggtgtctgggagtctgacggagtgacaaagatcgacggaatcggtacccagatgcacgtttcgtattacgagaatcctgatattcaggcaagcaaggagaaacattatgtgcagatgcttcagcttatggcaaatacaggaaagctcgtgaagatctccgagcttgatatgggctatgtagaccgcaacggaaatactgtgggaacagcggacatgaccgaccagcagcatagggccatggcggattattatgacttcatcgtgcgcaagtactttgagatcgtgcctcctgcacagcagtatggcatcacgcagtggtgcatgacggatgctcccggagctatcggcacaggctggagaggcggtgagcctgtgggcctgtgggaccagaattacaaccgcaagtatgcgtacgcaggatttgcaaacggacttagagcgaaataa

SEQ ID NO: 286 - protein, 522 aa, Unknown
  Obtained from an environmental sample.
MNRNTSPDFKLGAGVTVSDFLNKGRQYEVAVANLDEMTAGNAMKQSSVMRPDGSMDFTQVRRFIEEAERVGMTVYGHTLAWHSQQQNAYLNGLIKGKKTEVEPGQESEVVLLQTDFNDGNVTFNGWGNNSSRTVENGALKLTNPSVVNSWEAQFAYDFSEAFEMDKTYKLKFRIKGSAAGKIAAGFQITDGYLSAGEFGTVEFNTQWKDVELSCVCSAEGGTRLIFSFGEFAGDIYIDDFCFSVEGAGYIYEDLTPAEKKERLTEAMDRWIKGMMEVTATRVSAWDAVNEAISGRDTNGDGFYELESAQWGSSNNFYWQDYLGSGDYVRIVIAKARKYYEEFGGTAPLRLFINDYNLESDWDDNKKLKSLIHWIGVWESDGVTKIDGIGTQMHVSYYENPDIQASKEKHYVQMLQLMANTGKLVKISELDMGYVDRNGNTVGTADMTDQQHRAMADYYDFIVRKYFEIVPPAQQYGITQWCMTDAPGAIGTGWRGGEPVGLWDQNYNRKYAYAGFANGLRAK

SEQ ID NO: 287 - DNA, 1695 bp, Unknown
  Obtained from an environmental sample.
atgactattcatctacaaaaaaatctgctctttgcagcagtcttactgacagggcaagcagcgcatgcgctcacctccggatctggcgaggccacgctggatgttaataacagctggggttcaggttattgcgctaacgtcaccattgccaacaacggcagccaagccattacttcctggacggttggcctgaaccttaacggcacgacgatcaataatctttggaacggtaatttgagtggggttacggttacccccgtggcctacaatgcgaatgtggcgccgggtgctaataccagctttggtttctgtgctaatggcagcgcaacccccacgttggcgacgtttgaagttcaaggcggcggtggcgcagccagtagttccagcagttctgctatttcaagcagctccagcagttcggttgccggcggcagcaacagcgtcaccgtacgcatgagcggcgtaaccggagacgaaagcgtgagcctggaaatcggtggtcagaccatcgagacctggaccctgagcgtcggtatgctcgactacaccgtacagaccaacgctaccggtgagttgcgtgttgcgtttaccaatgatgaaggtgaccgcgatgtcgaagtggattacatcatggtcaacggcgtgacctatcaggccgaagatcaggaagataacaccggcgcgtgggacggagagtgtggtgcgggttccttctcgcagatgctgcactgcaacggttctatcggctttggcaatccattcgatggcagcaactcgtcgtccagctccagcaacacttcgagctcgagcagcagctctaaccctaaccctggcaatccgaatttccccgatttcttcgtaggtaacatcaccaccagcggctcagttcgctctgacttcatgcagtattgggatcaaattacgccggaaaacgaaggtaaatggggctccgtagagggaactcgcgaccagtacaactggggtccgctggatgcaatttacaatttcgcccgtgcgaacggtattcctgtaaaagcgcacactctggtgtggggcagtcagcaaccgggttggattggcggcttgagtgccgctgagcagcgcgcggaaattgaagagtggattcgcgattactgcgcacgctacccggatacggcgatgatcgatgtggtgaatgaagctctgccttcgcacgctccggcaaactatgcggccaatgcatttggaagcgattggatcactgaatccttccgtttggcacgtcagtactgtccggatgccgtgctgatctacaacgactataacttcatgacctgggacaccgatgccatcattcagatgattcgcccagccgtgaactccggttatgtcgatgcactgggtcttcaagcgcacagcctgtattccccacaagtctggaccgctcagcaaatccagagcaaattggatcagatttccgagttgggcttgccgctgtacatctccgagtacgacatcgaagcaacgaatgatcagactcagttacagtacatgcagatgcacttcccgatcttctacaaccatcccaacgtggccggtattaccctttggggttatgttgtgggtgctacctggcgtgatggcactggcctgatccaaagcaatggtcagcagcgcccggccatgcagtggttgatggagtatctaaaccgctaa

SEQ ID NO: 288 - protein, 564 aa, Unknown
  Obtained from an environmental sample.
  SIGNAL (1)...(23)
MTIHLQKNLLFAAVLLTGQAAHALTSGSGEATLDVNNSWGSGYCANVTIANNGSQAITSWTVGLNLNGTTINNLWNGNLSGVTVTPVAYNANVAPGANTSFGFCANGSATPTLATFEVQGGGGAASSSSSSAISSSSSSSVAGGSNSVTVRMSGVTGDESVSLEIGGQTIETWTLSVGMLDYTVQTNATGELRVAFTNDEGDRDVEVDYIMVNGVTYQAEDQEDNTGAWDGECGAGSFSQMLHCNGSIGFGNPFDGSNSSSSSSNTSSSSSSSNPNPGNPNFPDFFVGNITTSGSVRSDFMQYWDQITPENEGKWGSVEGTRDQYNWGPLDAIYNFARANGIPVKAHTLVWGSQQPGWIGGLSAAEQRAEIEEWIRDYCARYPDTAMIDVVNEALPSHAPANYAANAFGSDWITESFRLARQYCPDAVLIYNDYNFMTWDTDAIIQMIRPAVNSGYVDALGLQAHSLYSPQVWTAQQIQSKLDQISELGLPLYISEYDIEATNDQTQLQYMQMHFPIFYNHPNVAGITLWGYVVGATWRDGTGLIQSNGQQRPAMQWLMEYLNR

SEQ ID NO: 289 - DNA, 2796 bp, Unknown
  Obtained from an environmental sample.
atgaagttcactttgacaccgctgctgtgcgggttcgccttattgttgggttgcgcggtgcaggcaaccccagccgcttcgttaaagcaggcctatcagccgtttttccatatcggcaccgcagtcagtctggcgcaattacaaccatccaaagaacatgaacgcgctttaattgcgcagcactttaacagtctgaccgccgaaaacctgatgaaatgggaggaaattcaacccacggaaggcaactttgattttaaagcggccgatcagttggttgcgtttgccgaacaacatcaaatgtggatgatcggccataccattctgtggcatgaacaaaccccagactgggtgtttcaggggctggatggcaaacccgccagcaagcagctgctactggcccgcttgaccaaacatatccaaacggtcgttggccgttaccagggccgggtcaatggctgggatgtggtgaatgaagcgctcaatgaagatggcagcctgcgcgataccccgtggcggcgcattttgggtgatgattacattgccaccacttttgcgttggtgcatcaggtcgaccctaaagccaaactctattacaacgattacaacctgtttaaaccggaaaaacgcgccggggtgctgcggattatccaacaactgcagcaaaaaaatgtgcctattcatgccattggtgaacaagcgcattacggccttgattcgcctgcattcaaagacgttgaagattcgatcaacgcttttgctgccaccggcctggacgtgatgctaaccgaactggagatttcagtattgccgtatccatccggcatgacgcagggtgccgatatcagtcagcatcaggaattgcaggaacaactaaacccctatcgcgatggtttgcccaaagccgtcgaacaagcctggcaacaacggtatctcgatttgttttcgctgttattacgccagcagcaaaaactgcatcgcgtgaccttctggggcttagatgatggccaaagctggcgtaataatttcccgatgcgcggtcgcaccgattacccactgctgtttgatcgcaagctgcaagccaaaccgctgttaagcgcactgacggcattagccgcagaccagactaaagccaagcccaaaatgaatcagctgggctttgcgccgacttcgaccaaactgttgattgtgccgggtcggcaatcagtgccttttcatgttttggataccgagaccggccaaacggtgctgcaaggccaaagttcggcggccaggttttggcctgaatcgggggaatgggtcagtgctgccgatttttctgcggtgataactcccggcacctatcagatcaacatctcaggaacgccgccacaaactgtcaagatccaggccgaaccctatgccgcgctgcatgatgcggcaatcaaagcctattattttaaccgcgcctcgctcacactggagccaaagtttgccggaccttgggcacgcgcagcggggcatccggataccaaagtacgggtgcatgcttctgctgcatcggccagcaggccagaaggttatgagctcagcgctgccaaaggctggtatgacgccggtgactacaacaaatacgtggtgaattccggcattaccagttacaccctgttgcaggcctggcaggattttcctgagttttatcaaagccggacctggaatattccggagtccggcaacgcggtaccggacattctcgacgaaaccttatggaatctgcagtggttcagcgccatgcaagacccaaacgacgggggcgtctatcacaagctgactgaactgaatttttcggcaacccaaatgccggaccaagtgacagcagagcgttatgtggtgcaaaaaaccaccgccgcggcactgaatttcgctgcggtgttggccaaagccagtacggtttttgccaaatttgacgcccagttgcccggcctgtcgcaacaataccgtcagcaagcactgctcgcctggcaatgggcgcaaaaaaatccgcagcaaatctatcaacaacccaaagatgtccacactggcgcttatggtgacaaacaactggctgatgaatgggcctgggctggcgccgagctgtatttattgaccggcgagcaaagttatctgcagccactgttggcgctggacacgccaatcagtgcagcatcctgggccagtgtcagcgctttggggtatttttctttggcttcggcgaaacagcttgagcccgcactacggcaacaggtacaacagaaaatccaacaagccgccgcgcaaatcctgcaggaacatcaaacatccgcctatcaggtggcgatgaccaaaaacgattttgtctggggcagtaatgcggtggcaatgaataaagcgatgttgttataccaggcgtggaaaatagcgccaaaaccggagctgctacaggcgatgcaaggtctggttgattacgttttggggcgcaacccgttgcagcagtcttatgtcacagggtttggcgagcaaagcccgcagcagatccaccaccgaccttcggccgccgatgccatcaaagcgccggtaccaggttggttagtcggtggtgcacagccgggtaagcaggataaatgcacttatgccggcgctttacccgctgtcggcgctttacccgctgccagcaccttaccagccaccacttatcttgatgactggtgcagttacgccaccaacgaagtggcgattaactggaatgcacctttggtgtatgtgctggcatggcacctttcgcaaaacaccaagacaccataa

SEQ ID NO: 290 - protein, 931 aa, Unknown
  Obtained from an environmental sample.
  SIGNAL (1)...(22)
MKFTLTPLLCGFALLLGCAVQATPAASLKQAYQPFFHIGTAVSLAQLQPSKEHERALIAQHFNSLTAENLMKWEEIQPTEGNFDFKAADQLVAFAEQHQMWMIGHTILWHEQTPDWVFQGLDGKPASKQLLLARLTKHIQTVVGRYQGRVNGWDVVNEALNEDGSLRDTPWRRILGDDYIATTFALVHQVDPKAKLYYNDYNLFKPEKRAGVLRIIQQLQQKNVPIHAIGEQAHYGLDSPAFKDVEDSINAFAATGLDVMLTELEISVLPYPSGMTQGADISQHQELQEQLNPYRDGLPKAVEQAWQQRYLDLFSLLLRQQQKLHRVTFWGLDDGQSWRNNFPMRGRTDYPLLFDRKLQAKPLLSALTALAADQTKAKPKMNQLGFAPTSTKLLIVPGRQSVPFHVLDTETGQTVLQGQSSAARFWPESGEWVSAADFSAVITPGTYQINISGTPPQTVKIQAEPYAALHDAAIKAYYFNRASLTLEPKFAGPWARAAGHPDTKVRVHASAASASRPEGYELSAAKGWYDAGDYNKYVVNSGITSYTLLQAWQDFPEFYQSRTWNIPESGNAVPDILDETLWNLQWFSAMQDPNDGGVYHKLTELNFSATQMPDQVTAERYVVQKTTAAALNFAAVLAKASTVFAKFDAQLPGLSQQYRQQALLAWQWAQKNPQQIYQQPKDVHTGAYGDKQLADEWAWAGAELYLLTGEQSYLQPLLALDTPISAASWASVSALGYFSLASAKQLEPALRQQVQQKIQQAAAQILQEHQTSAYQVAMTKNDFVWGSNAVAMNKAMLLYQAWKIAPKPELLQAMQGLVDYVLGRNPLQQSYVTGFGEQSPQQIHHRPSAADAIKAPVPGWLVGGAQPGKQDKCTYAGALPAVGALPAASTLPATTYLDDWCSYATNEVAINWNAPLVYVLAWHLSQNTKTP

SEQ ID NO: 291 - DNA, 1230 bp, Unknown
  Obtained from an environmental sample.
atggtcaaagaaagaagttttcttcatcattcattcaataggggcgaaaatggacaggacagtctgatgtggaaaaaagaggcggatgatcgaatctcagagcatagacaaagagatcttgtgatcaacgtaacaaacggtgaaaaaaagccaatagcaggtatagaggttgaaataaagcaaatcagacatgaattcgcctttggttcagcgatgaatgatcaagtgttatttaatcaacaatatgctgattttttcgtgaagtattttaattgggctgtttttgaaaatgaggcaaaatggtatgcgaatgagccacaaagagggagaatcacctacgaaaaagcagatgcgatgctgaattttgcagatcgacatcagcttccagtgagagggcacgctttgttttgggaggtagaggatgcgaatccaagctggctaaggtcactgccaaatcatgaagtatatgaagccatgaaaaaccggcttgagcatgcgggcaatcactttaagggaaggttccgtcattgggatgtaaacaatgaaatgatgcatggttcattttttaaagatcgctttgggaaaaatatttggaagtggatgtatgaagaaacgaaaaaaattgaccctcaagcactattgtttgtgaatgattataatgtgatctcatatggtgaacaccatgcctataaagcgcatatcaatgaactgcgtcagttaggcgcacctattgaggcgattggggttcaaggccattttgaagaacgggtcgatccagtcattgtcaaagagagactcgatgtgcttgctgagctaggtcttccaatatgggtcacagagtacgattcggttcaccctgaccctaatcgaagagcggataacctggaagctttatatcgcgtcgcatttagtcatccagccgtaaaaggagtgctgatgtggggattttgggcaggtgcccattggagaggggaaaatgcagccatcgtgaattatgattggtctttaaatgaagcaggaagacgttatgaaaagcttctaaatgagtggacgacccaaagaattgaaaaaacagatgctaatggccatgtgagatgtccagcatttcacggaacatatgaggttcgaatcggtaaagaaagtaaaatgttgaaacagcagacgattgaacttgattcaaatgaacaaacaccgtttcaactagacgtgatcctgcctcaagaaggatag

SEQ ID NO: 292 - protein, 409 aa, Unknown
  Obtained from an environmental sample.
MVKERSFLHHSFNRGENGQDSLMWKKEADDRISEHRQRDLVINVTNGEKKPIAGIEVEIKQIRHEFAFGSAMNDQVLFNQQYADFFVKYFNWAVFENEAKWYANEPQRGRITYEKADAMLNFADRHQLPVRGHALFWEVEDANPSWLRSLPNHEVYEAMKNRLEHAGNHFKGRFRHWDVNNEMMHGSFFKDRFGKNIWKWMYEETKKIDPQALLFVNDYNVISYGEHHAYKAHINELRQLGAPIEAIGVQGHFEERVDPVIVKERLDVLAELGLPIWVTEYDSVHPDPNRRADNLEALYRVAFSHPAVKGVLMWGFWAGAHWRGENAAIVNYDWSLNEAGRRYEKLLNEWTTQRIEKTDANGHVRCPAFHGTYEVRIGKESKMLKQQTIELDSNEQTPFQLDVILPQEG

SEQ ID NO: 293 - DNA, 1002 bp, Unknown
  Obtained from an environmental sample.
atgaagatgaacagctccctcccctccctccgcgatgtattcgcgaatgatttccgcatcggggcggcggtcaatcctgtgacgatcgagatgcaaaaacagttgttgatcgatcatgtcaacagtattacggcagagaaccatatgaagtttgagcatcttcagccggaagaagggaaatttacctttcaggaagcggatcggattgtggattttgcttgttcgcaccgaatggcggttcgagggcacacacttgtatggcacaaccagactccggattgggtgtttcaagatggtcaaggccatttcgtcagtcgggatgtgttgcttgagcggatgaaatgtcacatttcaactgttgtacggcgatacaagggaaaaatatattgttgggatgtcatcaacgaagcggtagccgacgaaggagacgaattgttgaggccgtcgaagtggcgacaaatcatcggggacgattttatggaacaagcatttctctacgcttatgaagctgacccagatgcactgcttttttacaatgactataatgaatgttttccggaaaagagagaaaaaatttttgcacttgtcaaatcgctgcgtgataaaggcattccgattcatggcatcgggatgcaagcgcattggagtttgactcgcccgtcgcttgatgaaattcgtgcggccattgaacgatatgcgtcccttggtgttgttcttcatattacggaactcgatgtatccatgtttgaatttcacgatcgtcgaaccgatttggcagctccaacgtcagaaatgatcgaacggcaggcagagcggtatgggcaaatttttgctttgtttaaggagtatcgcgatgttattcaaagtgtcacattttggggaattgctgatgaccatacatggctcgataactttccagtgcacgggagaaaaaactggccgcttttgttcgatgaacagcataaaccgaaaccagctttttggcgggcagtgagtgtctga

SEQ ID NO: 294 - protein, 333 aa, Unknown
  Obtained from an environmental sample.
MKMNSSLPSLRDVFANDFRIGAAVNPVTIEMQKQLLIDHVNSITAENHMKFEHLQPEEGKFTFQEADRIVDFACSHRMAVRGHTLVWHNQTPDWVFQDGQGHFVSRDVLLERMKCHISTVVRRYKGKIYCWDVINEAVADEGDELLRPSKWRQIIGDDFMEQAFLYAYEADPDALLFYNDYNECFPEKREKIFALVKSLRDKGIPIHGIGMQAHWSLTRPSLDEIRAAIERYASLGVVLHITELDVSMFEFHDRRTDLAAPTSEMIERQAERYGQIFALFKEYRDVIQSVTFWGIADDHTWLDNFPVHGRKNWPLLFDEQHKPKPAFWRAVSV

SEQ ID NO: 295 - DNA, 1134 bp, Unknown
  Obtained from an environmental sample.
atgagatccgtccgcatcgtcacctttgctctcgccgccgcgctggccgtcccgctggtgacgtcgacggccacggccaagccgtccgccgaccacgaggccgcgccccactccaacgccaagttcgaccgcctgcgctgggccgcccccgaagggttcttcataggctccgcggcggccggcggcggccaccacctcgaacaggactacccggaccccttcaccttcgacaagaagtaccggaagatcctgggccagcagttcaactcggtctccgccgagaaccagatgaagtgggagttcatccaccccgagcgcgaccagtaccgcttcgaggaggccgacgccatcgtcgagttcgcccagcggaaccgccaggccgtgcgcgggcacaccctcctgtggcacagccagaaccccgaatggctggaggagggcgacttcaccaaggaggaactgcgcgccatcctcaaggaccacatcgacacggtcgtcggccgctacgccggcaagatccagcagtgggacgtggccaacgagatcttcaacgaccaggccgagctgcgcaccgacgagaacatctggatacgtgagctcggcccggagatcgtcgcggacgccttccgctgggcccacgaggccgaccccgaggccaagctgttcctcaacgactacaacgtcgagggcatcaacgccaagagcgacgcctactacgagctcgcccaggagatgctggagcagggcgtgccgctccacggattcggcgcccagggccacctgagcacccgctacggcttcccgggcgacctgcagcagaacctgcagcggttcgccgacctcggtctggagaccgccatcaccgagatcgacgtccgcatggacctcccggcgagcggcaagcccaccaaggagcagctgcggcagcaggccgactactaccagcaggcactgtcggcctgcctggccgtgaacgactgcaactccttcaccatctggggcttcaccgacaagtactcgtgggtgccggtcttcttcgagggtgagggcagcgccacggtcatgacggagaagttcgtccgcaagccggccttcttcgccctgcagtccaccctgaaggaggcgcgcaagcgctga

SEQ ID NO: 296 - protein, 377 aa, Unknown
  Obtained from an environmental sample.
  SIGNAL (1)...(26)
MRSVRIVTFALAAALAVPLVTSTATAKPSADHEAAPHSNAKFDRLRWAAPEGFFIGSAAAGGGHHLEQDYPDPFTFDKKYRKILGQQFNSVSAENQMKWEFIHPERDQYRFEEADAIVEFAQRNRQAVRGHTLLWHSQNPEWLEEGDFTKEELRAILKDHIDTVVGRYAGKIQQWDVANEIFNDQAELRTDENIWIRELGPEIVADAFRWAHEADPEAKLFLNDYNVEGINAKSDAYYELAQEMLEQGVPLHGFGAQGHLSTRYGFPGDLQQNLQRFADLGLETAITEIDVRMDLPASGKPTKEQLRQQADYYQQALSACLAVNDCNSFTIWGFTDKYSWVPVFFEGEGSATVMTEKFVRKPAFFALQSTLKEARKR

SEQ ID NO: 297 - DNA, 1842 bp, Unknown
  Obtained from an environmental sample.
ttgaggtcaggcgcgttctgtttcatcatagtcgttttaatcctgaaccttatatgcagggagttgtatgagtgtaaaaaagttgttaccgcagcactggtatgcttggctttcgggtcatcgctgacttgggggcaatgcaccacatttaccaccagtaccattcggaattgcgatggtatagattacgagctctggagccagaataactctggcacgaccaatatgcaaatcacgggagggaactcgaatccaaacggtggaacctttgaggcgacatggagtggcacgatcaatgttctattccgcgcgggtaaaaaatggggcacatccagcaccagtacccccaaaaccatcggcaatatctctcttgaattcgcagcgacatggagttcggtcgataatgtgaaaatgcttggcatctatggctgggcgtattatccctcgggaagcgaaccaacaaaaacggaaagcggtcaaagcacgaacttttccaatcagattgagtattacatcattcaagaccgcggtagctataacccggcatccggcggcaccaacgccaaaaagtacggtgaagggacgatcgacggaatcgcgtatgatttttatgtcgccgaccgtatcggccaggccatgctgacaggaacgggaaatttcaaacagtacttcagcgtgccgaagagcacaagcagtcacaggcaaagcggcacggtttccgtctccaaacattttgaggcctgggaaaaagcgggcatgaagatgatggattgtcggttatacgaagtcgcgatgaaagtggaatcgtataccggttccgcgaatggcaacggctcggcgaaagtgaccaaaaatctcctcacgatcggcggaagcagcagcaacgagtttagtctcgtaacgaatgtttctcctgccagcgcgggaacggtgtccaagagcccggacaacgcatcctatgccccgaacgcctccgttcagctcacggcgaccccgaataccggttggaagtttgtgggctgggaaggggacgcctcgggttccacgagcccaaccagcgttaccatgagcaaagacctcacggttacagcgaagtttgagctggtatcggaagaaggcagcacaaacctgatccaggatggcaacttcccgagcggcagcgtaatctctacagatgacggggcttcatggaaactcggacaaggggaaaactggggaaattccgcagccacaacgagcgtcagcaatggaatcgcgacagtcaatgtgacaactgtcggagcggaagcttatcaaccgcagcttgtacagtacggtttgggactcgacatggacatgagttacaaacttaccttcaaggcaagagccgatgcggcaaggaagattgaagttgcgttccagcaggcggtggatccttgggctggttatgcttcccaggaattcgacctgaccacgaccgatcaggatttcgagttcgtattcacgatgaccaacgccagcgacccggcatcacagttcgcgttcaatcttggccaggcgacaggcgatgtctatatcagtgatgttaaactggtatacacgacaggcaccacacccatatcccgcaccatagtccgcggcaatacggcattcgtctcggtaagtggcagaaccctgaatatttcggcagtcgacgcgtccacacttcagatcaaggtagtagatataaacggaaaggtaagagcgaatttcaacacggctggtgcagcaagtgtttccttgtccaatattcctgcgggccagtacttcgttggtatcacaggcacaggcataaaacaaatctcaccgatcgttttggaataa

SEQ ID NO: 298 - protein, 613 aa, Unknown
  Obtained from an environmental sample.
MRSGAFCFIIVVLILNLICRELYECKKVVTAALVCLAFGSSLTWGQCTTFTTSTIRNCDGIDYELWSQNNSGTTNMQITGGNSNPNGGTFEATWSGTINVLFRAGKKWGTSSTSTPKTIGNISLEFAATWSSVDNVKMLGIYGWAYYPSGSEPTKTESGQSTNFSNQIEYYIIQDRGSYNPASGGTNAKKYGEGTIDGIAYDFYVADRIGQAMLTGTGNFKQYFSVPKSTSSHRQSGTVSVSKHFEAWEKAGMKMMDCRLYEVAMKVESYTGSANGNGSAKVTKNLLTIGGSSSNEFSLVTNVSPASAGTVSKSPDNASYAPNASVQLTATPNTGWKFVGWEGDASGSTSPTSVTMSKDLTVTAKFELVSEEGSTNLIQDGNFPSGSVISTDDGASWKLGQGENWGNSAATTSVSNGIATVNVTTVGAEAYQPQLVQYGLGLDMDMSYKLTFKARADAARKIEVAFQQAVDPWAGYASQEFDLTTTDQDFEFVFTMTNASDPASQFAFNLGQATGDVYISDVKLVYTTGTTPISRTIVRGNTAFVSVSGRTLNISAVDASTLQIKVVDINGKVRANFNTAGAASVSLSNIPAGQYFVGITGTGIKQISPIVLE

SEQ ID NO: 299 - DNA, 1047 bp, Unknown
  Obtained from an environmental sample.
atgtttttgagtctcaaaagagtggcggcgcttgtttgcgtcgccggtctcggcatctctgcggcccaagcacagacctgcctgacctcgagtcaaaccggcactaacaacggcttctactattcgttctggaaagacaatcccggcaccgtgaatttctgtctgcagtccggcggccgctacacctccaactggagcggcatcaacaactgggtcggcggaaagggatggcagacgggttcccgcagagtggtgaactactcgggcagcttcaattcgcctggcaatgggtacctgactctctatgggtggaccaccaatccgctcatcgagtactacattgtcgacaactggggcacgtatcgtccgccgggtgggcaggggttcatgggcacggtgaccagcgatggcgcgacgtatgacgtctatcgcacgcagcgcgtcaatcagccctgcatcaccggcagcagttgcacgttctatcaatactggagcgtgcggcagtcgaagcggaccggtggcacgatcaccaccggcaaccacttcgatgcctgggccagctacggaatgaatctgggcgctcacaactaccagatcatggcgaccgagggctatcaaagcagcggcagctctgacatcacggtgagtgagggaagcagcagcagtagcagcggtggtggcagcagcacgagcagcagtggcggcggcggcaccaagagcttcacggtccgggcgcgcggaaccgcgggtggtgagtccatcacgctgcgtgtgaacaatcagaacgtgcagacctggacgctgggcaccagcatgacgaactacacggcatcgacgtcgttgagcggtggcatcaccgtggcttacacgaacgacagtggcaatcgcgacgtgcaggtggattacatcatcgtgaacggctcgacgcgtcagtcagaagcgcagagctacaacaccgggctctatgccaacggtagttgtggtggcggctccaatagcgaatggatgcattgcaacggcgccattggctacgggaatacgccgtag

SEQ ID NO: 300 - protein, 348 aa, Unknown
  Obtained from an environmental sample.
  SIGNAL (1)...(24)
MFLSLKRVAALVCVAGLGISAAQAQTCLTSSQTGTNNGFYYSFWKDNPGTVNFCLQSGGRYTSNWSGINNWVGGKGWQTGSRRVVNYSGSFNSPGNGYLTLYGWTTNPLIEYYIVDNWGTYRPPGGQGFMGTVTSDGATYDVYRTQRVNQPCITGSSCTFYQYWSVRQSKRTGGTITTGNHFDAWASYGMNLGAHNYQIMATEGYQSSGSSDITVSEGSSSSSSGGGSSTSSSGGGGTKSFTVRARGTAGGESITLRVNNQNVQTWTLGTSMTNYTASTSLSGGITVAYTNDSGNRDVQVDYIIVNGSTRQSEAQSYNTGLYANGSCGGGSNSEWMHCNGAIGYGNTP

SEQ ID NO: 301 - DNA, 642 bp, Unknown
  Obtained from an environmental sample.
atgtttaagtttacaaagaaattcttagttgggttaacggcagctttgatgagtatgagcttgttttcggcaaacgcctctgcagctaacacagactactggcaaaattggactgatgggggcggaacagtaaacgctgtcaatgggtctggcgggaattacagtgtgaattggtctaataccggaaatttcgttgttggtaaaggttggactacaggttcgccatttaggacgataaactataatgccggagtttgggcgccgaacggcaatgcatatttgactttatatggttggacgcgatcccctctcatagaatattatgtagtggattcatggggtacttatagacctactggaacgtataaaggtacggtttacagtgatgggggtacatatgacgtgtacacaactacacgttatgatgcaccttccattgatggcgataaaactacttttacgcagtactggagtgttcgccagtcgaagagaccaactggaagcaacgctacaatcactttcagcaatcacgttaacgcatggaagagatatgggatgaatctgggtagtaattggtcttaccaagtcttagcgacagagggatatcgaagtagtggaagttctaacgtaacagtgtggtaa

SEQ ID NO: 302 - protein, 213 aa, Unknown
  Obtained from an environmental sample.
  SIGNAL (1)...(28)
MFKFTKKFLVGLTAALMSMSLFSANASAANTDYWQNWTDGGGTVNAVNGSGGNYSVNWSNTGNFVVGKGWTTGSPFRTINYNAGVWAPNGNAYLTLYGWTRSPLIEYYVVDSWGTYRPTGTYKGTVYSDGGTYDVYTTTRYDAPSIDGDKTTFTQYWSVRQSKRPTGSNATITFSNHVNAWKRYGMNLGSNWSYQVLATEGYRSSGSSNVTVW

SEQ ID NO: 303 - DNA, 1404 bp, Unknown
  Obtained from an environmental sample.
ttgactataaaggcctggcccgggacggctgccagctataataccaatagaggttttatcatgtcctacgctcagtttaagggggccgctaccctagcgacgtccttcctgctcgcagtcaccttgacagcctgtggaggcagcaaatccaaacccgttctgccagacccatcgaacagcagctcgtcatcaagcagcagctcgtcatcaagcagcagctcctcaagttcctccagtagcagttcgagctcttctagtgctccctccagccaaacgttcttcattgagccggatttccagcttcacaccctggcggacttcccgattggagtggcagtctcggcagccaatgagccatacagcatcttcaaccaaaccgatggtactgatcggcaggatgtgatcctggagcatttcaacgaaatgaccgctggcaacatcatgaaaatgagctacgtgtacgcaggtcaacgtgcaaatcagcaacccgatcaattcgacttcagcagagctgatgagctggttgggtttgcccacgcaaacagtgtgaagattcacggtcacgccctcgtttggcacgccgactatcaagttccgggtttcatgcagaattatgatggcgactttgctgagatgttggccaatcacgcgcggagtgttgtggaacattttgacgaagagtttccaggtaccgtggtcagctgggatgtggtcaacgaggcgataaccgacaacttcggaaccgatacaaatggctggcgccggtcgctgttttacaacgcgctgccgcccgcgacagaagacgatattcctgagtacatccgcgttgccttccaggccgctcgcgatgccaacccggacatcgacctctattacaatgattacgacaataccgccaacaccaaccggctgaacaaaaccctgcagatcgccgatgccctggccgaggacgagctgatcgacggtgtgggattccagatgcacgtctatatgacgtacccgagccttagtcacttccaaaacgcgtttcaagaagtggttgatcgaggcttgaaggtgaagatcaccgagctggacgtatcggtggtcaacccatacggtcagagcactccgccaccgcagcccgtctacgatgaagcgttggcaggcgcacagaaaaagcggttctgcgatatcaccagagtctatctggaaacggttccggctgagcttcgcggcggtctcactgtttgggggcttgccgacaacgaaagctggttgatgcaacagttcaggaacgcaacgggagcgaactacaccgacgtgtggccgttgttgttcaacgccgacctgtcagccaaacctacactccaaggcgtggccgatgctctgcagggtctcccctgcaccaccgacctcgactaa

SEQ ID NO: 304 - protein, 467 aa, Unknown
  Obtained from an environmental sample.
  SIGNAL (1)...(74)
MTIKAWPGTAASYNTNRGFIMSYAQFKGAATLATSFLLAVTLTACGGSKSKPVLPDPSNSSSSSSSSSSSSSSSSSSSSSSSSSSSAPSSQTFFIEPDFQLHTLADFPIGVAVSAANEPYSIFNQTDGTDRQDVILEHFNEMTAGNIMKMSYVYAGQRANQQPDQFDFSRADELVGFAHANSVKIHGHALVWHADYQVPGFMQNYDGDFAEMLANHARSVVEHFDEEFPGTVVSWDVVNEAITDNFGTDTNGWRRSLFYNALPPATEDDIPEYIRVAFQAARDANPDIDLYYNDYDNTANTNRLNKTLQIADALAEDELIDGVGFQMHVYMTYPSLSHFQNAFQEVVDRGLKVKITELDVSVVNPYGQSTPPPQPVYDEALAGAQKKRFCDITRVYLETVPAELRGGLTVWGLADNESWLMQQFRNATGANYTDVWPLLFNADLSAKPTLQGVADALQGLPCTTDLD

SEQ ID NO: 305 - DNA, 3705 bp, Unknown
  misc_feature: Bacterial DNA
atgaagagtattgtaaacagagttgtatctatcgttacagctttaataatgatttttgggacatcactgctttcacaacacataagggcatttgctgatgacactaatacaaatctggtttctaatggggactttgagacaggcacaattgatggctggattaagcaaggtaatcctacattagaagtaacgactgaacaagcaattgggcaatacagtatgaaagttacgggtagaacacagacatatgaaggacctgcatatagctttttaggaaaaatgcagaaaggtgaatcatataatgtatcgcttaaagttagacttgtttctggacaaaattcttctaatccttttattaccgtgactatgtttagagaagatgacaatggcaagcattatgatacaatagtttggcaaaaacaagtttctgaagattcatggactactgtaagcgggacttatacattagattatactggaacattaaaaacattatacatgtatgtagaatcacccgatccaacgctggaatactatattgatgatgttgtagtgacaccacaaaatccaatacaagtaggaaatgtgattaccaatggaacttttgaaaatggaaatacttcaggatgggttggaacaggctcatctgttgttaaggcagtgtatggagtggctcatagcggaggttatagtttattgacgacagggagaacagctaattggaatggtcctagctatgatttgactggcaaaatagtaccaggtcaacaatacaatgttgatttttgggtgaaatttgttaatggcaatgatacagaacaaataaaggctactgttaaagcgacttctaacaaagacaattatatacaagttaatgattttgtaaatgtaaataaaggcgaatggacagaaataaaaggcagttttactttacctgtgacagattacagcggtgtcagcatctatgtagaatctcaaaatcctactttagagttttacattgatgatttttctgtaataggtgaaatttcaaataatcagattacaatacaaaatgatattccggatttatattcagtattcaaagattatttccccatcggtgttgcagttgattcgagtagattaaatgatgctgatccacatgctcaattgactgctaaacattttaatatgcttgttgcagaaaatgccatgaaaccggaaagcttgcagcctacagagggaaactttacctttgataatgctgataagattgttgattatgaaatagcacataatatgaagatgagaggtcatacattgctttggcataatcaggttccggattggtttttccaggacccatctgatccgtctaaaccagcttcaagggatctgctgcttcaaagattaagaacgcacataacaactgtgttagatcattttaaaacaaaatacggttctcaaaatccaataatcggatgggatgttgtaaatgaggttcttgatgataatggcaatttaagaaattctaagtggttacaaattataggacctgattatatagaaaaagcttttgaatatgcgcatgaggcagatccatctatgaaattgtttattaatgattacaacatcgaaaataatggcgttaaaacacaggcaatgtatgatttagtgaaaaagttaaaaagtgaaggtgtgcctataaacggaataggcatgcaaatgcacataagcataaattcaaatatagacaatataaaagcttctatagaaaaacttgcatcattaggtgtggaaatacaggtaactgaattagatatgaacatgaatggtaatgtatctaacgacgcattgcttaagcaagcgagattgtataaacaattatttgacttatttaaagcagaaaaacaatatataactgctgtagttttttggggagtttcagatgatgtaagttggcttagtaagccaaatgctccactactttttgattcaaagttacaggcaaagccagcatactgggcaattgtagatcaaggcaaagccatacctgacattcaatctgcaaaagctttagaaggatcaccgacgattggtgcaaatgttgatagttcttggaaacttgtaaaaccattgtatgctaatacttatgtgaaaggaactattggagcaactgctgctgttaaatctatgtgggatactaaaaacttatatttgttagtacaagtttcagacaatactccatctaataatgatggtatcgagatttttgtggataagaatgacaacaaatctactacctatgaaagtgacgatgaacattatatagttaagagggatggtacagggagttcaaatattacaaagtatgtaatgtctaatgctgatggatatgtagcacagatagctattccaattgaagacattagtcctgtgctgaatgataaaattggatttgatatcagaataaatgatgaccaaggcagtggcaatataaatgcgataacagtttggaatgattatacaaacagtcaagatactaatacagcatattttggagatttagtattatcaaaacctgcacagattgcaacagctatatatggcactcctgttattgacggtaaagtagatggtatttggaataatgctgaagctatttcgacaaatacatgggtcttgggttcaaatggtgctactgcaacagcaaaaatgatgtgggacgataaatatctttatatattggcagatgtaacagataacaatttaaataaatccagtgtgaatccttatgaacaggattctgtggaagtttttgtagatcagaataatgataagacaacttattatgaaaatgatgatgggcagtttagagttaactatgataatgaacaaagttttggaggaagcactaattcaaatggatttaagtcggcaacaagtcttacacaaaatggatatattgtagaagaagctattccttggacgagtattactccgtcaaatggtactatcatagggtttgacttgcaagttaacgatgcagatgaaaatggtaagaggacaggtattgtcacatggtgtgatccaagcggaaattcttggcaagatacttctggatttggaaacttgatgcttacaggtaagccatctggtgtccttaaaaaggttgtggcatttaatgacataaaagacaattgggcgaaagacgtaatagaagtattagcgtcaaggcacatagtagaagggatgacagacacccagtatgaaccaaacaagacagtgacgagagcagaatttacagcaatgatactgaggctattaaacataaaagaagaagcatacagcggagaatttagcgatgtaaaaagtggagactggtatgcaaacgcgatagaagcagcatacaaaacaggaataatcgaaggtgacggaaagaacgcaaggccaaatgacagcataacaagagaagagatgacagcaatagccatgagggcatacgagatgctgacacagtacgaagaagagaatataggtgcgacaacatttagcgacgacaaatccataagcgattgggcaagaaatgtagtggcaaatgcagcgaaattaggaatagtaaatggtgagccaaataacgtatttgcacctaaaggaaatgccacaagagcagaagcagcagctatcatatacggcttattagaaaaaacaaataagctttaa

SEQ ID NO: 306 - protein, 1234 aa, Unknown
  DOMAIN (1)...(1234): Bacterial protein
  SIGNAL (1)...(32)
MKSIVNRVVSIVTALIMIFGTSLLSQHIRAFADDTNTNLVSNGDFETGTIDGWIKQGNPTLEVTTEQAIGQYSMKVTGRTQTYEGPAYSFLGKMQKGESYNVSLKVRLVSGQNSSNPFITVTMFREDDNGKHYDTIVWQKQVSEDSWTTVSGTYTLDYTGTLKTLYMYVESPDPTLEYYIDDVVVTPQNPIQVGNVITNGTFENGNTSGWVGTGSSVVKAVYGVAHSGGYSLLTTGRTANWNGPSYDLTGKIVPGQQYNVDFWVKFVNGNDTEQIKATVKATSNKDNYIQVNDFVNVNKGEWTEIKGSFTLPVTDYSGVSIYVESQNPTLEFYIDDFSVIGEISNNQITIQNDIPDLYSVFKDYFPIGVAVDSSRLNDADPHAQLTAKHFNMLVAENAMKPESLQPTEGNFTFDNADKIVDYEIAHNMKMRGHTLLWHNQVPDWFFQDPSDPSKPASRDLLLQRLRTHITTVLDHFKTKYGSQNPIIGWDVVNEVLDDNGNLRNSKWLQIIGPDYIEKAFEYAHEADPSMKLFINDYNIENNGVKTQAMYDLVKKLKSEGVPINGIGMQMHISINSNIDNIKASIEKLASLGVEIQVTELDMNMNGNVSNDALLKQARLYKQLFDLFKAEKQYITAVVFWGVSDDVSWLSKPNAPLLFDSKLQAKPAYWAIVDQGKAIPDIQSAKALEGSPTIGANVDSSWKLVKPLYANTYVKGTIGATAAVKSMWDTKNLYLLVQVSDNTPSNNDGIEIFVDKNDNKSTTYESDDEHYIVKRDGTGSSNITKYVMSNADGYVAQIAIPIEDISPVLNDKIGFDIRINDDQGSGNINAITVWNDYTNSQDTNTAYFGDLVLSKPAQIATAIYGTPVIDGKVDGIWNNAEAISTNTWVLGSNGATATAKMMWDDKYLYILADVTDNNLNKSSVNPYEQDSVEVFVDQNNDKTTYYENDDGQFRVNYDNEQSFGGSTNSNGFKSATSLTQNGYIVEEAIPWTSITPSNGTIIGFDLQVNDADENGKRTGIVTWCDPSGNSWQDTSGFGNLMLTGKPSGVLKKVVAFNDIKDNWAKDVIEVLASRHIVEGMTDTQYEPNKTVTRAEFTAMILRLLNIKEEAYSGEFSDVKSGDWYANAIEAAYKTGIIEGDGKNARPNDSITREEMTAIAMRAYEMLTQYEEENIGATTFSDDKSISDWARNVVANAAKLGIVNGEPNNVFAPKGNATRAEAAAIIYGLLEKTNKL

SEQ ID NO: 307 - DNA, 3729 bp, Unknown
  Obtained from an environmental sample.
atgaaatccgccatcggcgacgctgcgtttatggcggcgatggaacgcaactccgacatcgtgacgatgcagtgctacgcacctatctttgtcaatgtcaatcccggcgggcggcagtggcgccccaatttgatgggctacgatgcgttaagcgctttcggctcgccctcgtattacgccatcaaaatgttcagcaacaatttgggcgatacgattttgaagcccagtctcagcggtgcgcgcctgccagtttccgttacacaagagcagaaaagcggcacgattttcattaaattggtgaacccgcaaacgacgccacagagcgtaaaaattgatctcaaaggcgtgcgctccgtcgaattcagcggcaccgccactgttttagctgccgactccggcgcgcttaactccattgatgcgcctaccaaagtcgttcctgtcacgcgcagaattactggaatcagcccctcgtttgcgcaaacgctggagccgtattcgattactgttttgcaaatcaaggccactgctctgccaacggcgacagcaaacgccgttgcgccgccaaccttcaccacggagccaaaagtgaacaccaccacgcccgttactattcccgttgcgacttcgcagccgcagccagtttcgcaaccgtcgccagatgcaaacgctatcgcgccgctgaaaaacgctttcaaaggcaagttcctcattggcaccgtgttgagcgggccagacctgcgcggccagcaaacgcgcagcgtgggtatcgccaccacgcatttcgacgcctttacggcagaaaacgaaatgaagccggatgcgatgcagcctcgcgaaggacaattcaactttgctgccggcgaccgcttagtggaactggccgaaaaaagcggcgccacgcccatcggccacacgctaatctggcactcgcaaacaccacgctggttctttgaagggccggacggacaaccggcgaatcgtgaattggccttggcgcggatgcgcaagcatattgcaaccgtcgtcggccactacaaagggcgcgtcaagcagtgggacgtggtgaacgaagccataaacgatggccccggcgtgctgcgccaaagcccgtggctgcgcgctatcggcgaagactacatcgctgaagcgtttcgagccgcgcacgccgccgaccctgacgcaattctcatctataacgattacaacatcgaaatgggctacaaacggcccaaagcaatccaactcttaaaatctctggttgatcagaaagtgccgattcatgcggttggtattcagggccactggcgtatggacaccaacctcaccgaagtggaacaagctattaaagaattctcggcgctgggcctgaaggtgatgatcactgaactcgacatcggtgttttgccgacgcgttatcagggcgctgatatttcgcaggtgcaaaacatgacgcctgaacagcgcgccgccgtgaacccatataccaatggtttgcccgacgacgtagcgcaaaaacacgccgataaatatcgccaggccttcgatattttcctgcgctacaaagatgtcatcgaacgcgtcacgttctggggtgtggacgatgctcattcgtggctgaacggtttcccgattcgcgggcgcaccgattacccattgcttttcgaccggcagggcaaacctaaacccgcctttttcgccgtgcaaaacctggctttaggcgtgaccgccgcgccgcaatcgaatgcttcgtctgcacccagagctgtcgctcaagctgcgccggcaaccagcaatattcgtggccaggaatttccacgggtcgaaagcgatttgcgtgtgacgtttcgcatcaaagcccccgaagcgcaaaaagtgcagttcgatttaggcaagccttacgacgcgacccgcgatgctgaaggcaactggacggcaaccaccgagccgcaggtgcccggctttcactattacaatttggtgattgacggcgtgcgcgtgaacgacccggccagcgaaaccttttacggcgcgggccgccagatgagcggcatcgaaatccccgaccctgacagcgccttttattcgccgcaaaacgtgccgcacggcgaagtgcgcgagcgctggtatttttccaacaccacgcaggcgtggcgtcgcattttcatttatacgccgccgggttatgacacgaatcaagtggagcgttttcccgttttgtatttacagcatggcggcggcgaagatgagcgcggctggcctcaacagggtcgcatgagctttatcatggataatctcatcgccacacgtaaagccaaaccgatgcttgtggtgatggaacaaggctatgcgcgcaagcccaacgagccgcaggtgccgttgcgcccgcccggcggtagcgccggagccatgccccccgatttcaatcgcatgttcggcacactgggtgaagtgttcaccaaagacctgattccctttattgatgctaattaccgcaccaaaaccgaccgcgaaaaccgcgccatggccggactttcgatgggcgggatgcaaagtttccttattggcttgtcgaacaccgatttattcgcgcacatcggaggcttcagcggcgcgggcggcggtttcggtggcggcaccttcgacgcaaaaacggcgcacggcggtgtaatggccgacgccgacgcgttcaacaaaaaagttcgcacgctgtttctcagcatcggcacagcggaaaacgaacgctttcagagcagcgtgcgcggttaccgcgatgcgctgaccaaagcgggcatcaaaaccacattctacgaatcgcccggcacctcacatgaatggctgacatggcggcgtagcctgaaagaattcgcaccgctcttgtttcaagaagtcgaagtgcaaattgagcgcggcccgaatgcgcgcccaattgcgccgcaaccgattaatctcggccccgacgataaacccgcatttcccccggtgcccgccggtttcgatgtccgccgcaacgatattccgcatggcgaaatcaaactcgtggaatatccatccgctacagtgggcacaaatcgtaagatgcaggtttacacgccgcccggttacaatccgcaagaaaagtatgcggtgctttatctgttgcacggaatcggcggcgacgagtgggaatggaaaaatggcggcacgccggaagtgattctcgataatctttacgccgcgaaaaaactccagccgatgattgtggtcatgcccaatggccgcgcgcaaaaagatgaccgtccaatcggcaatgtgttcgcatcagcgcctgcttttgaaaccttcgagaaagatttactcaacgacgtaattccgtttatcgaaaagaattatccagtcaaaaccggcgccgaaaatcgcgcgcttgcgggcctttcgatgggcggtgggcaatcgctgaactttggtctgggcaatctcgacacctttgcgtgggtcggcggcttttcttcggcgcccaacacgcgcactggcgcaaggctattagccaatcccgacgatgccaaaaagaagctgaaattgttatgggtttcgtgtggcgataaagacggcttgtttttcatcagccagcgcacgcatcgctatctcgccgaaaacaatgtgccacacgtctggcatgtgcagcccggcggccacgatttccgagtgtggaagcaagacctttataacttttcgcaactgctgttccgctaa

SEQ ID NO: 308 - protein, 1242 aa, Unknown
  Obtained from an environmental sample.
MKSAIGDAAFMAAMERNSDIVTMQCYAPIFVNVNPGGRQWRPNLMGYDALSAFGSPSYYAIKMFSNNLGDTILKPSLSGARLPVSVTQEQKSGTIFIKLVNPQTTPQSVKIDLKGVRSVEFSGTATVLAADSGALNSIDAPTKVVPVTRRITGISPSFAQTLEPYSITVLQIKATALPTATANAVAPPTFTTEPKVNTTTPVTIPVATSQPQPVSQPSPDANAIAPLKNAFKGKFLIGTVLSGPDLRGQQTRSVGIATTHFDAFTAENEMKPDAMQPREGQFNFAAGDRLVELAEKSGATPIGHTLIWHSQTPRWFFEGPDGQPANRELALARMRKHIATVVGHYKGRVKQWDVVNEAINDGPGVLRQSPWLRAIGEDYIAEAFRAAHAADPDAILIYNDYNIEMGYKRPKAIQLLKSLVDQKVPIHAVGIQGHWRMDTNLTEVEQAIKEFSALGLKVMITELDIGVLPTRYQGADISQVQNMTPEQRAAVNPYTNGLPDDVAQKHADKYRQAFDIFLRYKDVIERVTFWGVDDAHSWLNGFPIRGRTDYPLLFDRQGKPKPAFFAVQNLALGVTAAPQSNASSAPRAVAQAAPATSNIRGQEFPRVESDLRVTFRIKAPEAQKVQFDLGKPYDATRDAEGNWTATTEPQVPGFHYYNLVIDGVRVNDPASETFYGAGRQMSGIEIPDPDSAFYSPQNVPHGEVRERWYFSNTTQAWRRIFIYTPPGYDTNQVERFPVLYLQHGGGEDERGWPQQGRMSFIMDNLIATRKAKPMLVVMEQGYARKPNEPQVPLRPPGGSAGAMPPDFNRMFGTLGEVFTKDLIPFIDANYRTKTDRENRAMAGLSMGGMQSFLIGLSNTDLFAHIGGFSGAGGGFGGGTFDAKTAHGGVMADADAFNKKVRTLFLSIGTAENERFQSSVRGYRDALTKAGIKTTFYESPGTSHEWLTWRRSLKEFAPLLFQEVEVQIERGPNARPIAPQPINLGPDDKPAFPPVPAGFDVRRNDIPHGEIKLVEYPSATVGTNRKMQVYTPPGYNPQEKYAVLYLLHGIGGDEWEWKNGGTPEVILDNLYAAKKLQPMIVVMPNGRAQKDDRPIGNVFASAPAFETFEKDLLNDVIPFIEKNYPVKTGAENRALAGLSMGGGQSLNFGLGNLDTFAWVGGFSSAPNTRTGARLLANPDDAKKKLKLLWVSCGDKDGLFFISQRTHRYLAENNVPHVWHVQPGGHDFRVWKQDLYNFSQLLFR

SEQ ID NO: 309 - DNA, 1830 bp, Unknown
  Obtained from an environmental sample.
ttgaaaaaactcacaatcgccctatcccttgcaatcacttttgccgcgccagtttttgcgacagatgcttgtttgcaaaatactcaattaaatgctaccgcccaaggagcacaaacctggactggcaaaaaaggagctacaactttaggcggttcaggtgacgatgcttatggagttgaaacttggacagaagctggtggagacgctactaaatttacatggtttggaccaaatcagggtggtggtttcgcttatagagcggaatggacaaattccacagattacttaggtcgctttggttatttttggggtattgacgggaaaaaatgggacaaattaggagacctttgcgttgattataactataaaagatctgccaatggcactggaggttcatattcttatataggcgtttatggatggacaaacgctggcggtggtactgaagctgaatattatatagttgaagattggtttggagaaaatcaacagactgcaaataatttaggcaatggttgccaagagcacggtgaaattacagtggacgagaaaagctataaagttgtcacttgcataagaccagcaggctctggctgcgtaacttgcaacggacaacaattcgggcaagtctttagcatacgccaaggcatgagaagcgaacaacctaaaacatgcggaacaatctccatcaaaaagcactttgaagaatgggtaaaaatgacaaccgaaaaaagcggacaatccccagctaaatatatttacgataaaacttatgaatccaaatttttagcggaggcacaaggcggcactggttggcttgaaaccactttccttaaattttctagaaacggtgattgcggcttcgatattcctgatggtcatttcacccttcaattagctacctctccgtctgagggcggtactgtaagcagaaacccaaaggaatcttcttatgcctccggttcaactgtaactctcacagccactccggcagcaggttggaaatttgccagttggagtggtgatgcatgtcaaaccacaagcccattgacagtcactatggacaaaaacaaggtaatcacagcgaaatttacccccgttgtagatctcaataaaaaccttgttacaaatggtactttcacgaataaagagagttggacttttaatactggttccagttatggcaactccgaaggaacttttgatgtgtcaaacagcgaaggcagaataaatgtgacgaaaattggctccaacccgtgggaaccacagctcgttcaaaatggcatcacccttgttgaaggaatgaattacaaaataacttttgaagcttctgcctctgctgctcgaaaaataggcttggttatacaaatggcaggcggcgattataccacttattttgaaaaagatatagacttgactgcctcaaatcaacaattttcgtatgaattcaaaatgaatgcaccaagcgatgaaagcggtcgtattgggtttaatcttgggcaaacgactggaaacgtcactctaagcaaaatcacccttcattatttagaagaagattcacacgaaccgtccgacaatccctgcgaagacccaagtccaattttgaaaaaacgcatccctgcaactcatttctcccttcaaacgcttagcgacaaagccttgcgcatagaagtgaacgctccaaccattgtggacatttttgacctgagagggaataaagttaagagtttgaatgtctccggctcgcaaacggttaaattatccctgccaagcggagtgtattttgccaaagcacgtggaatgaaaagcgtcagatttgtgttgaggtaa

SEQ ID NO: 310 - protein, 609 aa, Unknown
  Obtained from an environmental sample.
  SIGNAL (1)...(20)
MKKLTIALSLAITFAAPVFATDACLQNTQLNATAQGAQTWTGKKGATTLGGSGDDAYGVETWTEAGGDATKFTWFGPNQGGGFAYRAEWTNSTDYLGRFGYFWGIDGKKWDKLGDLCVDYNYKRSANGTGGSYSYIGVYGWTNAGGGTEAEYYIVEDWFGENQQTANNLGNGCQEHGEITVDEKSYKVVTCIRPAGSGCVTCNGQQFGQVFSIRQGMRSEQPKTCGTISIKKHFEEWVKMTTEKSGQSPAKYIYDKTYESKFLAEAQGGTGWLETTFLKFSRNGDCGFDIPDGHFTLQLATSPSEGGTVSRNPKESSYASGSTVTLTATPAAGWKFASWSGDACQTTSPLTVTMDKNKVITAKFTPVVDLNKNLVTNGTFTNKESWTFNTGSSYGNSEGTFDVSNSEGRINVTKIGSNPWEPQLVQNGITLVEGMNYKITFEASASAARKIGLVIQMAGGDYTTYFEKDIDLTASNQQFSYEFKMNAPSDESGRIGFNLGQTTGNVTLSKITLHYLEEDSHEPSDNPCEDPSPILKKRIPATHFSLQTLSDKALRIEVNAPTIVDIFDLRGNKVKSLNVSGSQTVKLSLPSGVYFAKARGMKSVRFVLR

SEQ ID NO: 311 - DNA, 3972 bp, Unknown
  Obtained from an environmental sample.
atgcggaaaagagtaatagctttatttgtaactctcatctttgtcatgtctattttaagtccaggatatcttccatttctgagtactaaagcaaatgctcaaacacaaaatacaccaacaattttaaaatttgattttgaaagcggtaatcaaggctggacggggagaggtctttcaacaactgttgcaaccgtttacaatgttgcttatgaaggtgattattcattaaaagtttctggcagaaatgcttcatgggatggagctgttattgatttaacagacaagctttcggcaaatgtgagttatacagtttctctgtttgttcgtcacagtgaccaaaaacctcaaagattttcagtatatgcatatgtaaaagattcagcaagtgaaaaatatattccagttgtagataaagttgcagttcctaattattggaagcaactggttggtaaattcacaatcaacacttcaaatccagtccaaaagattcagctgcttgtctgtgttcctacaaataaatcattggaattttttatcgatagcgtattaattgcaagtagtgcaggagcaacatctggagttgtaaaatccacaaattttgaaagcggtacaacagaaggctggcaagcaaggggaacaggttctgttgctcagattagtgttgtttctacagtagctcattcaggtagtaaaagtttgtatgtgacagggcgagttcaaacgtggcaaggtgcacaaatagatttgacaagtttgttagagaagggtaaagaatatcagttttctgtgtgggtatatcaggatagtggaagcgaccaaaagctgacactgaccatggaaaggaaaaatgcagatggaagtacaaattatgatacaataaaatggcagcaaacagtttcaagcaatacatgggtagagctaacaggttcatatacagtacctgcaacagcaacacaactaatattctacattgaatcacccaatgctaccctaagcttttatattgatgattttactgctgttgataaaaatgcaccagttgtagcgcctggaattataaaatcagccacatttgaaagcggtacaacagaagactggcaagcaagagggacaggagtgaccgtttctgttgttaacacagtggcacatactgggagcaagagtttgtatgtgacagggagaagtcaaaattggcatggtgcagaaattgatctgacaaatgtgctagagaagggcaaggaatatcaattttctgtgtgggtatatcaggatagtggaagcgatcagaagctgacattgaccatgcaaaggaaaaatgcagataacacaacagattatgattctataaaatatcagcagacagtagcaacaaatacatgggtagagctaacaggttcatatacagtgccgacaacagccacccagttaattttatatgttgaagctgcagatactaccctaagcttttatattgatgattttactgctgttgataaaaacccagaggtaataccaacagtatcgagagtaccagaatgggaaattccttcactctttgagcagtatacgaattatttcagcattggtgtggcaataccatataaagtacttacaaatccaaccgaaaaggcaatggtactcaaacatttcaacagtataacagctgagaatgaaatgaaacctgatgctattcaaaagacagaagggaattttacatttaatgttgcagaccaatacgtagattttgcacagcaaaatagaattggaatcagaggtcacactcttgtttggcatcagcaaacaccaaattggttcttccagcatagtgatggtactccgcttgatccaagcaatcctgctgacaaacaacttctacgcgatagattaagaacgcatatccaaacacttgttggaagatacgcagggaaaatttatgcatgggatgttgtaaacgaggcaattgacgagaaccagccagatggatacagaagaagtgaatggtacagaatattggggccaactgatacaacagatggcattccagaatatattctgcttgcattccagtatgcaagagaggcagacccaaatactaagctcttttataacgactataatacagaaaatccaaagaaaagacagtttatatacaatcttgttaagaagctcaaagaaagaggcttgattgatggtgtaggtctgcagtgccatattaatgtcgattcacctacagttaaagagatagaggatacaattaaactgtttagtacaatccctggcttagacattcacattacagagcttgacattagcgtttatacaagcagcagccagagatatgatactcttccacaggatataatgataaaacaggctttgaagttcaaagagctttttgagatgctaaaaagatatagctatgttgtcacaaacgttactttctggggactcaaagatgactattcatggctttcaacaagcagatctaactggccactactgtttgacaacaactaccaggcaaaatttgcatactgggcaattgttgaaccgtcagtattgccacttgctataaacaaaggatatgcaaacaatgcatcagcaaggatagatggagttttagacagagaatacaaaggtgcgattccaattaagattacaaatgaaagtggacaagaagttgcaactgttcgagctctatggaattcaagtgaactcagcctctatatatcggtcaatgatacaacaatagatgctgctaatgataaagtagttgtatttgtagaccaggataatggaaaaatgccagaaattaaacctgatgactattgggtttcaattacgagaactggtacaaaagcacaatcagctcaaggctatgtaaaggattatgctgtcgtgcagcaagcaaatggatatgtggttgagttgaagcttttaattaataacacgttaactgttaactcttctataggttttgatatagcaatctttgacaatggagttcaatacagctggaatgacaagacaaactcacagtttatagaaactgataactatggtattttaacaatggcagatagcgtcaagtttgcttctgctccaaaaggtacagcaataattgatgcagaattagatgatacatggaaaaacgctcaggaaataacaactgacacaaaggtcacggttacaggcacagtatacgactcagcttatgcaaaggctaagatgatgtgggatgaaaatagtatctatgtctatgcaattgtttatgacttgcttttgaacaaggctaatacaaatccatgggagcaggattcaattgagatatttgtggatgaaaataatcacaaaacgccttactatgaaaatgatgatgttcagtacagagtgaactatgagaatactcaaacatttggcacgaacggtgctcctcagaacttcattacagcaacaaagataattccaaacggatatatagtggaagctcaagtttacatgaggacgacaaagctttctgaaggaatggttataggctttgacattcaagtgaatgatgcagaccatacaggtaaaagagtcggtgttctaacctggaatgataaggttgggaacaattatagagacacaacaaggtttagatgcttagagcttgtagcagcacctgtaagccagccaccaatacaagctccatcaccatcacaaccaacaacaataacgtatatactaacaccgacaccaacacagccatcaacccaaacacagcagcaacctgctcagcaaccatcacagcagcaacagcaaccgcaacagcagcagcctgcacagacacaacaacctcagacacagcctgcacaaaagcctcagaatgttgtttcgataaagatagaccagacaaaagctgagacatttactgttggcgctgataccaaggttgttgtacctcaaggttctgtaactggtgcaaactga

SEQ ID NO: 312 - protein, 1323 aa, Unknown
  Obtained from an environmental sample.
  SIGNAL (1)...(33)
MRKRVIALFVTLIFVMSILSPGYLPFLSTKANAQTQNTPTILKFDFESGNQGWTGRGLSTTVATVYNVAYEGDYSLKVSGRNASWDGAVIDLTDKLSANVSYTVSLFVRHSDQKPQRFSVYAYVKDSASEKYIPVVDKVAVPNYWKQLVGKFTINTSNPVQKIQLLVCVPTNKSLEFFIDSVLIASSAGATSGVVKSTNFESGTTEGWQARGTGSVAQISVVSTVAHSGSKSLYVTGRVQTWQGAQIDLTSLLEKGKEYQFSVWVYQDSGSDQKLTLTMERKNADGSTNYDTIKWQQTVSSNTWVELTGSYTVPATATQLIFYIESPNATLSFYIDDFTAVDKNAPVVAPGIIKSATFESGTTEDWQARGTGVTVSVVNTVAHTGSKSLYVTGRSQNWHGAEIDLTNVLEKGKEYQFSVWVYQDSGSDQKLTLTMQRKNADNTTDYDSIKYQQTVATNTWVELTGSYTVPTTATQLILYVEAADTTLSFYIDDFTAVDKNPEVIPTVSRVPEWEIPSLFEQYTNYFSIGVAIPYKVLTNPTEKAMVLKHFNSITAENEMKPDAIQKTEGNFTFNVADQYVDFAQQNRIGIRGHTLVWHQQTPNWFFQHSDGTPLDPSNPADKQLLRDRLRTHIQTLVGRYAGKIYAWDVVNEAIDENQPDGYRRSEWYRILGPTDTTDGIPEYILLAFQYAREADPNTKLFYNDYNTENPKKRQFIYNLVKKLKERGLIDGVGLQCHINVDSPTVKEIEDTIKLFSTIPGLDIHITELDISVYTSSSQRYDTLPQDIMIKQALKFKELFEMLKRYSYVVTNVTFWGLKDDYSWLSTSRSNWPLLFDNNYQAKFAYWAIVEPSVLPLAINKGYANNASARIDGVLDREYKGAIPIKITNESGQEVATVRALWNSSELSLYISVNDTTIDAANDKVVVFVDQDNGKMPEIKPDDYWVSITRTGTKAQSAQGYVKDYAVVQQANGYVVELKLLINNTLTVNSSIGFDIAIFDNGVQYSWNDKTNSQFIETDNYGILTMADSVKFASAPKGTAIIDAELDDTWKNAQEITTDTKVTVTGTVYDSAYAKAKMMWDENSIYVYAIVYDLLLNKANTNPWEQDSIEIFVDENNHKTPYYENDDVQYRVNYENTQTFGTNGAPQNFITATKIIPNGYIVEAQVYMRTTKLSEGMVIGFDIQVNDADHTGKRVGVLTWNDKVGNNYRDTTRFRCLELVAAPVSQPPIQAPSPSQPTTITYILTPTPTQPSTQTQQQPAQQPSQQQQQPQQQQPAQTQQPQTQPAQKPQNVVSIKIDQTKAETFTVGADTKVVVPQGSVTGAN

SEQ ID NO: 313 - DNA, 1392 bp, Unknown
  misc_feature: Bacterial DNA
gtgaaacgtctatccgcgctgaccgccgtcgtattgttagcgctaacaactcacgtcgccgccgctgaccccgcgccacccgccaccggccccgccatcgacttccgggccgaactccagcccatcgacggattcggcttctccatggccttccagcgggccgacctgctgcacggcgcgcgcggcctcagccccgccaagcggcgcgaggtgctcgacctgctgctcgacaaggagaggggcgcgggcctgtcgatcctgcgcctgggcatcgggtcgtcgaccgaccgggtctacgaccacatgccgacgatcctgccgaccgatcccggcgggccggacgccccgccgaagtacgtctgggacggctgggacggcggccaggtctggctcgccaaggaggccaaggcgtacggcgtcaagcggttcttcgccgacgcctggagcgcgccggccttcatgaagaccaacggcagcgagaacgacggcggcgagctccggcccgaatggcgccaggcctacgcgaactacctcgtcaagtacgcgaagttctaccaacgggaaggcatcccgatcaccgacctggggttcaccaacgaacccgactgggcggcgacctacgcctcgatgcgtttcaccccgcagcaggccgtcgacttcctcaaggtgctcgggccgaccgtccgcgcgtccggactgaagaccggcgtcgtctgctgcgacgcggcgggctgggaccggcaggtcgcctacaccgaggccatcgaggcggaccccgaggccgccaaggccgtgcggaccgtcaccggccaccgctacagcggtccgaccacggtcccgcagcccaccgacaagcgggtctggatgtcggagtggtcaccggacggcaccacctggaacgagaactgggacgacggcagcggctacgacggcctcaccgtcgccgccgacatccagaacaccctcaccgtcggcaacgccaacgcctacgtctactggaccggcgcgtccctcggcgccacccggggactcatccagctcgccaaccccggcgactcctaccgggtgtccaagcggtactgggcgctggccgccttcagccgcttcatccgccccgacgccgtccgcgtaccggtcacgaacgccgacccggccctgagcgtcacggccttccgcaacaccgacggcagccgcgtgatcgagatcctcaacacggcgaccaccgagaagtccgcccagttcgccctccgcggcggccacgaccggcaccccgagggctacgtcaccgacgagacccgctcgatcaccccggcccacgtcgcctccgcgcgcggtacgaccctcaaggccacgctcgccccgcgcgcgctgaccacgatcgtcctcgactga

SEQ ID NO: 314 - protein, 463 aa, Unknown
  DOMAIN (1)...(463): Bacterial protein
  SIGNAL (1)...(22)
MKRLSALTAVVLLALTTHVAAADPAPPATGPAIDFRAELQPIDGFGFSMAFQRADLLHGARGLSPAKRREVLDLLLDKERGAGLSILRLGIGSSTDRVYDHMPTILPTDPGGPDAPPKYVWDGWDGGQVWLAKEAKAYGVKRFFADAWSAPAFMKTNGSENDGGELRPEWRQAYANYLVKYAKFYQREGIPITDLGFTNEPDWAATYASMRFTPQQAVDFLKVLGPTVRASGLKTGVVCCDAAGWDRQVAYTEAIEADPEAAKAVRTVTGHRYSGPTTVPQPTDKRVWMSEWSPDGTTWNENWDDGSGYDGLTVAADIQNTLTVGNANAYVYWTGASLGATRGLIQLANPGDSYRVSKRYWALAAFSRFIRPDAVRVPVTNADPALSVTAFRNTDGSRVIEILNTATTEKSAQFALRGGHDRHPEGYVTDETRSITPAHVASARGTTLKATLAPRALTTIVLD

SEQ ID NO: 315 - DNA, 1224 bp, Unknown; identical to SEQ ID NO: 67
  Obtained from an environmental sample.

SEQ ID NO: 316 - protein, 407 aa, Unknown; identical to SEQ ID NO: 68
  Obtained from an environmental sample.
  SIGNAL (1)...(28)

SEQ ID NO: 317 - DNA, 1695 bp, Unknown
  Obtained from an environmental sample.
gtggctggaagctcgctcacgagcaacggcctctcggccattctctcgctccagtcggactggggcagcggttactgcgcgacggtagaacttcagaacgtcggcggaactccgatcacggcgtgggaggtccaggtggagctcgctgggacgaccgtgaacagcagccacagcgcggcgttctcctcgacaggcacccgcctggtcgccaagcccttgtcctggaacgcgacgctggcacccgccgccaagacgaccttcggcttctgcgcggccgctccgagcgcagcggcgcgcccgtccgtggtgcaagtgacagcgaacggctccgccaccggaacgggcggaacgagcggcggcggcacgggcggctcgaccgctacgggcggctcgaccgctacgggcggctccggtgggtcgaccgcgggagtgtgcgcggcaacctacgaggccgagagcatgctccacagcaccggcaacgccatcagcggcggctggaacatctattcgaacggcaacatcaccgccacgcactccttcgcagccggctcgaatcgactcaccgtgcacgccaagggcgaccaggccaacggggcgcccatcatgcgcgtcagcgtgggcaacaccgtcgtcggcgaggtgccagtgccggtgaccgtgtggacaccgtactgcttcgactacgccgcggcgagcgcaggcgcgcagaccgtcaagatcgagttcacgaacgactacaatggcggcaccggcgccgaccgcaatctgcacgtggacaaggtcgcggtgcagtgcggcgcgagctgcaacagcgggagcggagggggcaccggcggctcgagcggaagcggcggcacctcggccaccggcggctccgccagcggtggcgcggcagggacgacctgcacgaacgttcgtcccactggaaccgactgggacgcggcgacctgcgacatgtgggcctcgcaaactagcgagtgcagcgcggcctggatgatcgacaaccattactgcgaccagagctgcgggcgctgctcgggcgggagcgggaccggtggcacgaacacgggaggcaccggcggtggagtgaccccgagtacctgcacggagcccaattctcagcagtgctccacctacaaggtcgggactcactgcggcctcacctacgagatctggaccgacggctccgcgggctgcatgacgaacacctcctacgggttcctcgccaattggagccaggggaacgcaaactacctggctcgcaagggcgttcggcccggctcgtcgcgaccggtcgtgacgtacagcgcgaactaccagccgaacgggaattcctacctggggatctacggttggacgcagaacccgctcgtcgagtactacatcatcgatagctgggggagctggcgtccaccggggacccaggcgatgggcaccgtccaggtggacggcgggacctacgatatctaccggagcgagcgggtgaacaagccctcgatcgagggcaacaagaccttctggcagtactggagcgtccgcacccagaagcgcaccagtgggaccatcaccgtggctccgcacttcgccgcgtgggcggcatccggactgcagatgggctccttctacgaggtctccctggtggtggagggctacaacagctccggcagcgccgacgtaacggtgtcgttccggtag

SEQ ID NO: 318 - protein, 564 aa, Unknown
  Obtained from an environmental sample.
MAGSSLTSNGLSAILSLQSDWGSGYCATVELQNVGGTPITAWEVQVELAGTTVNSSHSAAFSSTGTRLVAKPLSWNATLAPAAKTTFGFCAAAPSAAARPSVVQVTANGSATGTGGTSGGGTGGSTATGGSTATGGSGGSTAGVCAATYEAESMLHSTGNAISGGWNIYSNGNITATHSFAAGSNRLTVHAKGDQANGAPIMRVSVGNTVVGEVPVPVTVWTPYCFDYAAASAGAQTVKIEFTNDYNGGTGADRNLHVDKVAVQCGASCNSGSGGGTGGSSGSGGTSATGGSASGGAAGTTCTNVRPTGTDWDAATCDMWASQTSECSAAWMIDNHYCDQSCGRCSGGSGTGGTNTGGTGGGVTPSTCTEPNSQQCSTYKVGTHCGLTYEIWTDGSAGCMTNTSYGFLANWSQGNANYLARKGVRPGSSRPVVTYSANYQPNGNSYLGIYGWTQNPLVEYYIIDSWGSWRPPGTQAMGTVQVDGGTYDIYRSERVNKPSIEGNKTFWQYWSVRTQKRTSGTITVAPHFAAWAASGLQMGSFYEVSLVVEGYNSSGSADVTVSFR

SEQ ID NO: 319 - DNA, 1095 bp, Unknown
  Obtained from an environmental sample.
atgaaggtgacccgaacagctgtcgcgggcattgtcgccgcagcggtcctcatcacgatcggcacgtcgaccgcgtcggctgaggatgaaccaaccagcgagaacacgtcgacggatcagccgttgcgcgtcctggcagccaaagccgggatcgcgttcggcacggccgtcgacatgaacgcgtacaacaacgacgcgacctaccgtgagctcgtcggccaggagttctcgagcgtcacggccgagaacgtcatgaagtggcagctcctcgagccgcagcgaggggtctacaactggggtccggccgatcagctcgtgcgcgtagccaacgagaacggccagaaggtgcgcgggcacacgctcatctggcacaaccagctgcccacctggcttaccagcggagtcgcctccggtgagatcacaccggacgagctccggcagctcctgaggaaccacatcttcacggtgatgcgccacttcaagggcgagatccaccagtgggatgtcgccaacgaggtcatcgacgacagcggcaacctgcgcaacacgatctggctgcagaacctgggtccgagctacatcgcggacgcgttccggtgggctcgcaaggccgacccggacgccgccctctatctgaacgactacaacgtcgagggcccgaacgccaaggccgatgcgtactacgccctggtcaagcagctcctcgccgacgacgtgccggtggacggcttcggaatacaggggcacctcggtgtgcagttcggcttctggcccgcgagtgcggtggccgacaacatggggcgcttcgaggcactcggcctgcagacggcggtcaccgaggcggatgtccggatgatcatgccgcccgacgaggacaagctggccgcacaggcacgtggctacagcacgttggtccagggctgcctgatggccaagcgttgcaggtcgttcaccgtctggggcttcaccgacaagtactcctgggttccgggcaccttccccggccagggcgcggcgaacctcctggccgaggacttccagcccaagccggcttactacgccgtccaggatgacctcgcgcgcgccggacggtag

SEQ ID NO: 320 - protein, 364 aa, Unknown
  Obtained from an environmental sample.
  SIGNAL (1)...(27)
MKVTRTAVAGIVAAAVLITIGTSTASAEDEPTSENTSTDQPLRVLAAKAGIAFGTAVDMNAYNNDATYRELVGQEFSSVTAENVMKWQLLEPQRGVYNWGPADQLVRVANENGQKVRGHTLIWHNQLPTWLTSGVASGEITPDELRQLLRNHIFTVMRHFKGEIHQWDVANEVIDDSGNLRNTIWLQNLGPSYIADAFRWARKADPDAALYLNDYNVEGPNAKADAYYALVKQLLADDVPVDGFGIQGHLGVQFGFWPASAVADNMGRFEALGLQTAVTEADVRMIMPPDEDKLAAQARGYSTLVQGCLMAKRCRSFTVWGFTDKYSWVPGTFPGQGAANLLAEDFQPKPAYYAVQDDLARAGR

SEQ ID NO: 321 - DNA, 1608 bp, Unknown
  Obtained from an environmental sample.
gtggactggtgggacgtggatattttttccgcgaaggaaatcacccacccgcaactggcaaccttcctggatgcctcacgagaccatcgcaagccggtcatgatcggcgagatgaccccacgccacgtcggcgtgatcgaggggcagaaatgctgggatgaatggtttggcccgatgattgatctgctcaaacgtcgccccgaaatcaaggccacggcctatatcaactgggaatggcgcgagtggtccgaccgcctcggcttccgctggcacaactggggcgacgcccgcatcgagggcaacgcccttgttcgtgatcgctgggtgcaggaactctcccaccccatctatctccacgcggcgcgcgacggatcttgtccgctgccgccaatcaccgccctcccatccgcgaccccgtcgctccagaccgtgttccaggaccatttcctgatgggtgctgccttgaatgtgaggcagttcaccgaaaacgacgcaaccaagaccgctctcatcaagaagcaattcaacaccatcacgcccgagaatgttctcaagtgggggccggttcatcctgagcccaaccggttcaacttcgaatccaccgatcgttacgtggactttggtgtgaagaaccggatgttcatcgtcggccacaccctcgtctggcaccaccagacacccgcctgggtgtttcaagattcccaaggccagccgctcgaccgggatggactgctcaatcgcttgagcaaccacatccacacggtggttggacgctacaagggccgcatccacgggtgggatatggtgaacgaggccttgaacgatgacggcaccctccgccctagccaatggcttaaaatcatcggccccgactacattgccaaagcgtttgcccttgcccacgccgccgaccctgccgctgaactgtattacaacgattacagtctcgatcatcccgccaagtgtgctggtgcgatcgcgctggtgaagcagctccagacgaatggcatatccattgccgggattggcacgcagacccacgtcggactcaacggaccttccccccagtcggtggatgattcattgacggcctttggccagctcggcgtgaaggtcatggttaccgaactcgacgttgatgtgctgcccgccgccagccaaaatcaaaacgcggatctcaaccagcccgccttgtccaatcccgccctcaatcccgccctcaatccctatcccgatgggctgccgcaagccgtccaggacaaactggccgctcgctatgcggaactcttcgccgtgttcgtcaagcacgccgacaaaatcagccgcgtcacgttctggtgcgtcaccgacggcgactcctggctgaacaactggcccgtgcgtggccgcgtcaactatccgctgctgttcgaccgtgccagccagcccaagcccgccttcgatgcggtcattcgcgtcgccaaggacccgccgacggtttcgcacaatctcaccccgctccacgatgcggcgcgggtcctggtcaatccgcacaagggctggtaccaccactacccggacaatcacatcaacaagtatgagatcgcccgcgatgccgacctgacggaa

SEQ ID NO: 322 - protein, 536 aa, Unknown
  Obtained from an environmental sample.
MDWWDVDIFSAKEITHPQLATFLDASRDHRKPVMIGEMTPRHVGVIEGQKCWDEWFGPMIDLLKRRPEIKATAYINWEWREWSDRLGFRWHNWGDARIEGNALVRDRWVQELSHPIYLHAARDGSCPLPPITALPSATPSLQTVFQDHFLMGAALNVRQFTENDATKTALIKKQFNTITPENVLKWGPVHPEPNRFNFESTDRYVDFGVKNRMFIVGHTLVWHHQTPAWVFQDSQGQPLDRDGLLNRLSNHIHTVVGRYKGRIHGWDMVNEALNDDGTLRPSQWLKIIGPDYIAKAFALAHAADPAAELYYNDYSLDHPAKCAGAIALVKQLQTNGISIAGIGTQTHVGLNGPSPQSVDDSLTAFGQLGVKVMVTELDVDVLPAASQNQNADLNQPALSNPALNPALNPYPDGLPQAVQDKLAARYAELFAVFVKHADKISRVTFWCVTDGDSWLNNWPVRGRVNYPLLFDRASQPKPAFDAVIRVAKDPPTVSHNLTPLHDAARVLVNPHKGWYHHYPDNHINKYEIARDADLTE

SEQ ID NO: 323 - DNA, 2355 bp, Unknown
  Obtained from an environmental sample.
atgatgctcaatgcccgttgtatccaacttatgaagttgttgcttcgctcttctctttatcttaccgctgacaaattggcgcaatcattgaatgtatccaagcgaacgatttattacgatatacaaaaaacgaatgaatggttgcatcatgaagggctgaagccgattcaatatgcgcgcgggctcggatttcgcttggatgatgaagtgaaacaagaaataacaacaaagtggaacacattacaacctgcccgacattacacatatcagtcatgggagcgaaaagcttggattggtttatggattttgactcgcgttcatccactgtatttgtctgattttttagagaaattacatgtaagcaggagcacgttgttaaatgacataaaggaactgaaagaagattggcagtcatttcagttgcgattgtcattccatcgcaaaaaagggtatttttcatcaggggaagaaatccaaaaaaggaaattgatgattcgttatattcatcaaatattagcggcgatggatgaccagcatttcgctgcagaattgtcagctgagtgtcaatggccaatctttgattggatttgccaattcgagtctactttttctattcgctataccggtgaggttattcaaactttacctatttacctcgcattgttccaaagacggtgggctagaggcaaatttgtgcaaatggacgagcaagaaaaagaagtgctaaggtcaatgcgggaataccagattgctgatcatctcgttagacgaattgaaaacgtttccgaaatatctattcccgatgacgaggtttgttatttgacgacccatttactcagttttcgagttgcagatgacaagcaaatcgatcataacgatgacatcactactttgaaacgaatcattcgacatatggtggatgattttcaaacttatgcctgtgtacaattcaagcgtcgcgaagagttggaaaaaaatttattggttcatatgaagcctgcctattatcgactgaaatacggttttcatctgcaaaacgatctgaccgaatcggtcaaagcgaactatcaagatttatttaccttaacgaaaaaagtcgtccatcatttagaaagtgtagttggccagccggtcagcgacgatgaaattgcttatatcgccatgcattttggcggatggttggacagagagggggtgtcggttccagtacggaaaaaggtgttgatcgtctgcgagagcgggattggaacatcgcgaatgttgcaaaaacaattggatcaacgctacaaaaacgagttcacgattggtgcggcagtagaaccttatcaactacaaaatgaaaaagacgtacaaatgctaaagcgccacttcaacagcattgttgccgagaacgtaatgaaaccgatcagcattcaacctgaggaaggaaaattcaattttgaacaagcggatcgaattgtgaagttcgctaaggcaaatggcatggatattcgcttccatacactcgtttggcacagccaagtacctcaatggttctttcttgacaaggaaggcaagccaatggttaatgaaacagatccagtgaaacgtgaacaaaataaacaactgctgttaaaacgacttgaaactcatattaaaacgatcgtcgagcggtacaaagatgacattaagtactgggacgttgtaaatgaggttgtgggggacgacggaaaactgcgcaactctccatggtatcaaatcgccggcatcgattatattaaagtggcattccaaacagcgagaaaatatggcggcaacaagattaaactttatatcaatgattacaataccgaagtggaaccaaagcgaagcgctctttataacttggtgaagcaattaaaagaagagggcgttcctattgacggcatcggccatcaatcccacattcaaatcggctggccttctgaagcagaaatcgagaaaacgattaacatgttcgccgctctcggcttagacaaccaaatcactgagcttgatgtgagcatgtacggttggccgccgcgcgcttacccgacgtatgacgccattccaaaacaaaagtttttggatcaggcagcgcgctatgatcgtttgttcaaactgtatgaaaagttgagcgataaaattagcaacgtcaccttctggggcatcgccgacaatcatacgtggctcgacagccgtgcggatgtgtactatgacgccaacgggaatgttgtggttgacccgaacgctccgtacgcaaaagtggaaaaagggaaaggaaaagatgcgccgttcgtttttggaccggattacaaagtcaaacccgcatattgggctattatcgaccacaaatag

SEQ ID NO: 324 - protein, 784 aa, Unknown
  Obtained from an environmental sample.
MMLNARCIQLMKLLLRSSLYLTADKLAQSLNVSKRTIYYDIQKTNEWLHHEGLKPIQYARGLGFRLDDEVKQEITTKWNTLQPARHYTYQSWERKAWIGLWILTRVHPLYLSDFLEKLHVSRSTLLNDIKELKEDWQSFQLRLSFHRKKGYFSSGEEIQKRKLMIRYIHQILAAMDDQHFAAELSAECQWPIFDWICQFESTFSIRYTGEVIQTLPIYLALFQRRWARGKFVQMDEQEKEVLRSMREYQIADHLVRRIENVSEISIPDDEVCYLTTHLLSFRVADDKQIDHNDDITTLKRIIRHMVDDFQTYACVQFKRREELEKNLLVHMKPAYYRLKYGFHLQNDLTESVKANYQDLFTLTKKVVHHLESVVGQPVSDDEIAYIAMHFGGWLDREGVSVPVRKKVLIVCESGIGTSRMLQKQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQTARKYGGNKIKLYINDYNTEVEPKRSALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 325 - DNA, 1146 bp, Unknown
  Obtained from an environmental sample.
atgactatttcccgccggaaatttatgtggggcacagctgcactcctggccaccacccagctcaaaacccgcgctctcgccgctgccatggccagcacaggcatcaaggacgccttcaagggcgacttccatatcggcaccgccatcagcaacgctaccctgcaaaaccaggatgccaccatgctggatttgatcaagcgcgaatttaatgcaattaccgctgaaaattgcatgaagtgggagcctattcgcccacagctggatcagtggaattgggagctggccgaccgctttgtggatttcggcgttaaaaacaagatgtatgtggtaggtcacacgctgatttggcacagccaggcgccagcgcacatttatctcgacgccgatggtaagcccaacagtcgcgatgcccagttgaaagtaatggaggagcacatacgtaccctggcgggccgctacaaaggaaagatagacgcctgggacgtggttaacgaagcagtggaggatgatggcagctggcgtcaaaccggctggtacaaaaacatgggtgaagaatatatcgcccatgccttccgcttggcagccgaggtagaccccaacgccaagctactctacaacgactacaacgaggctgtacccgccaagcgtgatgcgattattcgggtggtaaaaggcgtgcagaaggctggcgcacccattcacggtgtggggatgcaagggcacatgagcctgtcacatccggatttcgcggagttcgaaaaatccataatcgaatacgccaagttgggggtgaaggtgcacgttaccgaactggatatcgacgtgttgccactggcgtggaacctgagtgcggaaatttccaatcgctttgaataccgcccagagatggatccttatcgcgaaggtttgcccgccaaagtcgaggaggagctagcggctcgttacgaggcgctgtttaaaatcctgctgcgtcatcgcgacaaaattgagcgtgtgaccacttggggcaccaacgactcagagacctggttaaatggcttccccattccggggcgcatgaattacccaatgctgttcgatcgtaataaccagcccaagttggcctatcaccggctgctggcactcaaacaaaagaaaagtcagtaa

SEQ ID NO: 326 - protein, 381 aa, Unknown
  Obtained from an environmental sample.
  SIGNAL (1)...(27)
MTISRRKFMWGTAALLATTQLKTRALAAAMASTGIKDAFKGDFHIGTAISNATLQNQDATMLDLIKREFNAITAENCMKWEPIRPQLDQWNWELADRFVDFGVKNKMYVVGHTLIWHSQAPAHIYLDADGKPNSRDAQLKVMEEHIRTLAGRYKGKIDAWDVVNEAVEDDGSWRQTGWYKNMGEEYIAHAFRLAAEVDPNAKLLYNDYNEAVPAKRDAIIRVVKGVQKAGAPIHGVGMQGHMSLSHPDFAEFEKSIIEYAKLGVKVHVTELDIDVLPLAWNLSAEISNRFEYRPEMDPYREGLPAKVEEELAARYEALFKILLRHRDKIERVTTWGTNDSETWLNGFPIPGRMNYPMLFDRNNQPKLAYHRLLALKQKKSQ

SEQ ID NO: 327 - DNA, 1500 bp, Unknown
  Obtained from an environmental sample.
atgaaacgttcagtctctatctttatcgcatgtttagtaatgacagtattaacaattagcggtgtcgcggcaccagaagcatctgcagcaggggcgaaaacgcctgtagcccttaatggccagcttagcattaaaggtactcagctagtcaatcaaaacggaaaatcggtgcagctgaaggggatcagctcacacggtttgcagtggttcggcgattatgtcaataaagactctttaaaatggctaagagacgattggggaattaccgtcttccgagcggcaatgtacacggctgaaggcggttatatagagaatccgtctgtgaaaaataaagtcaaagaagctgttgaagcggcaaaagagctcgggatatatgtcatcattgactggcatattttaaatgacggcaatccaaatcaaaataaagagaaggcgaaggaattctttaaggaaatgtcgagcctttacggaagcacaccaaacgttatttatgaaattgctaatgaaccgaacggtgatgtaaattggaagcgcgatatcaaaccgtatgcggaggaagtgatttccgttatccgtaaaaatgacccggataacatcattattaccggaactggcacttggagtcaggatgtcaatgatgctgctgatgatcagcttaaggatgcaaacgtcatgtacgcgcttcatttttatgcaggtacacacggccagtatttaagggataaagccgattatgcgctcagcaaaggagcgccgatttttgtaacggaatgggggacgagtgacgcttccggaaatggcggggtcttccttgaccagtcgagggaatggctgaattatctcgacaacaagaaaatcagctgggtaaactggaacctttctgataagcaggaatcttcctcagctttaaagccgggggcatctaaaacaggcggctggccgttatcagatttatccgcttcagggacatttgtaagggaaaagatccgtggctcccaacattcgactgaagacagatctgagacaccaaagcaagataaacccgtacaggaaaacagcctatctgtgcaatacagaacaggggatggaagtgtgaacagcaaccaaatccgtcctcagatccatgtgaaaaacaacagcaagaccaccgttaatttaaaaaatgtaactgtccgctactggtataacacgaaaaacaaaggccaaaacttcgactgtgactacgcgaagatcggatgcagcaatgtgacgcacaagtttgtgacattacaaaaacctgtaaaaggtgcagatgcctatctggaacttgggtttaaaaacgggacactgtcaccgggagcaaacactggagaaatccaaattcgtcttcacaatgaggattggggcaattattcacaaatcggggattattctttttctcagtcaaatacgtttaaagatacaaaaaaaatcacattatataataacggaaaactaatttggggaactgaacccaaatag

SEQ ID NO: 328 - protein, 499 aa, Unknown
  Obtained from an environmental sample.
  SIGNAL (1)...(29)
MKRSVSIFIACLVMTVLTISGVAAPEASAAGAKTPVALNGQLSIKGTQLVNQNGKSVQLKGISSHGLQWFGDYVNKDSLKWLRDDWGITVFRAAMYTAEGGYIENPSVKNKVKEAVEAAKELGIYVIIDWHILNDGNPNQNKEKAKEFFKEMSSLYGSTPNVIYEIANEPNGDVNWKRDIKPYAEEVISVIRKNDPDNIIITGTGTWSQDVNDAADDQLKDANVMYALHFYAGTHGQYLRDKADYALSKGAPIFVTEWGTSDASGNGGVFLDQSREWLNYLDNKKISWVNWNLSDKQESSSALKPGASKTGGWPLSDLSASGTFVREKIRGSQHSTEDRSETPKQDKPVQENSLSVQYRTGDGSVNSNQIRPQIHVKNNSKTTVNLKNVTVRYWYNTKNKGQNFDCDYAKIGCSNVTHKFVTLQKPVKGADAYLELGFKNGTLSPGANTGEIQIRLHNEDWGNYSQIGDYSFSQSNTFKDTKKITLYNNGKLIWGTEPK

SEQ ID NO: 329 - DNA, 2268 bp, Unknown
  Obtained from an environmental sample.
atgaggaacgttcaggaaataggaggcagtatgtacaaaaaggcttttcttgtactggcattgtttttgctgttggcggcggtggcgctcccgtctgtgggggctgcgccgcaggggccgcgcctgcgcgatgtggcgggcgacattttagtgggttacgcctccagaaacgatttctggaacatgtctgactcagcccaatacacagaagttgcccgcactgagttcaacttcatgacgcccgaaaacgccatgaagtgggacgccattcatcccgcgcaaaactcatacagttttgcccaggccgaccggcacgtgcagtttgcccaggccaacaacatggccgtgcatggacatgccctcgtgtggcacagccaaaatccaggctggctgaccaatggcaactggtcccgcagccaattgatcaacatcatgaacgaccacattgacacggtcgccggccgttatgcaggtgaggtgctggtgtgggacgtggtcaatcaggcgtttaatgaggatggaacttatcgcagcaccatctggtacaacgggatcggacaggaatatatcgacctggcctttacccgcgcccgcgccgccgatcctcatgccaaactcatttacaacgattacaacattggctggttaaacagtaagtcgaatggcgtctacaacatggccgccgatatggtcaggcgcggtgtgcccatcgacggcgttggtttccagatgcacctggaacggggcggcgtcagcggcagcagtctggcgagcaacatgcagcgtttcgccgatttgggattggaagtttacatcaccgaattggacgtgcgcattccccaaaacccaacccagcaggatttgcaggctcaggcggcagtttaccaaacggtgacgaatcgctgtttggcgcagcctgcctgcaaggcgttgcaggtctggggcatccccgacaaatattcctgggtaccggacgtattccccggcacgggcgcgcctctgttgtttaacgacaactatgaggccaaacccgcctattatgccgtccaggcagagttgatggccgcgaatccgcagcccacaaacacaccgggaacgcccgctcataccccttcggccacgtctacgtctgcggccactgctacgcccccggcaacggccacggcgaccgccaccaccccctccggcggcggcgtttgcgccgttgattacgtcattgccaaccagtggggcaatggctttcaggccaacgtcaccatcaccaatcacagcgccgcgccggtgaacggctataccctggcctggacccacgcgccggggcagattgtcaccagcggctggaacgtaaccatcgcccaaagcggcagcgccgtcagcgccagcaacccggccggttattggaacggtgtgatcggagccaacggcggcaagatttcttttggtttccagggatctctggcgggcggcagcgcggtcgcgcccacttattttgccttgaacggcgctgcctgtaacggggccgtccttccgcctactgccaccttcacgccttcaccgacggctaccatgtgtccccaggcaacgcctgaactgcttgtcgtgcagccggtgacttcacccactacccaactgtctcaaacgctggtggtgcgtttaggcaacggcgaatgggtgcgcgctgccggaccggcaggcgttgtcaccgtcactgcgccggacccggatggttatttccgcctgacgataccgctggcagccaataccagcaacgccattctggtagaagggcgggtgcgggttatcacccattcaaatggctgcacctatggcggttataccttgagcagaaccgtaacgattgtgcaagccagcagcccagtcaccttaacgccgactgccacaccttcccccaccgccacggcaacgcctacggtaaccgccacgtcgccgtcaggcgcctgcaccgtcgcctacgccatcaccaacgactggggcagcggtttcaccgccaacgttaccctcaccaatactggcggaagcgccctcaacggctggaccctggcctatgcctttcccggcaatcaaaccatcagcaacgcctggaacggaacggccgttcagtccggcagcagcgtcagcgtcaccaacgccggttggaatggcagcctgccgcccaacgtctccgccagctttggcttccaggcgagctacagcggcaataacagcgtccctgccagctttacgctgaacggcgcgctttgccattga

SEQ ID NO: 330 - protein, 755 aa, Unknown
  Obtained from an environmental sample.
  SIGNAL (1)...(35)
MRNVQEIGGSMYKKAFLVLALFLLLAAVALPSVGAAPQGPRLRDVAGDILVGYASRNDFWNMSDSAQYTEVARTEFNFMTPENAMKWDAIHPAQNSYSFAQADRHVQFAQANNMAVHGHALVWHSQNPGWLTNGNWSRSQLINIMNDHIDTVAGRYAGEVLVWDVVNQAFNEDGTYRSTIWYNGIGQEYIDLAFTRARAADPHAKLIYNDYNIGWLNSKSNGVYNMAADMVRRGVPIDGVGFQMHLERGGVSGSSLASNMQRFADLGLEVYITELDVRIPQNPTQQDLQAQAAVYQTVTNRCLAQPACKALQVWGIPDKYSWVPDVFPGTGAPLLFNDNYEAKPAYYAVQAELMAANPQPTNTPGTPAHTPSATSTSAATATPPATATATATTPSGGGVCAVDYVIANQWGNGFQANVTITNHSAAPVNGYTLAWTHAPGQIVTSGWNVTIAQSGSAVSASNPAGYWNGVIGANGGKISFGFQGSLAGGSAVAPTYFALNGAACNGAVLPPTATFTPSPTATMCPQATPELLVVQPVTSPTTQLSQTLVVRLGNGEWVRAAGPAGVVTVTAPDPDGYFRLTIPLAANTSNAILVEGRVRVITHSNGCTYGGYTLSRTVTIVQASSPVTLTPTATPSPTATATPTVTATSPSGACTVAYAITNDWGSGFTANVTLTNTGGSALNGWTLAYAFPGNQTISNAWNGTAVQSGSSVSVTNAGWNGSLPPNVSASFGFQASYSGNNSVPASFTLNGALCH

SEQ ID NO: 331 - DNA, 1242 bp, Unknown
  Obtained from an environmental sample.
gtgttcaagggcttgcgctatttgctgttgctgtgcctgagtgcgggactggtctttgcctgtgcgccacggtctgtgaccgccccacccgatgggctaagcgggcaaattaggctcctgcgccaaggaaccctcactgtccttgtccagaatgcccaagggcaacccattgccaacgccaaggtggtagctgctcagcaaacccatgccttcccctttggtgttgccttagatacagcaatgtttgagccttccccgccacccgcagccaactggtaccgcaacaccgctcgccaaaattttaatgccgctgtccatgaaaacgccctcaagtggtatgcccttgaaccggagcagggcaagctggactttacgatggcggatcgcatcctcgcttggagtgaagcccaaggctggccgatgcgggggcacaccctcttttgggaagttgagcaatttaaccccccatggctgaaaacgctgccaccagagcaactgcgggctgccgtcaagaaccatgccatgacggtgtgtcgccattaccgcgggcgaatcaatgaatttgatgtcaataatgaaatgctccacggtaactttttccgcagtcgtttgggaaacggcatagttaaagagatgttcgagtggtgccgcgagggtaaccccgaggccgtcctttatgtgaacgactacggcattattgagggcgatcgcctcgacgactacgtgcagcagattcgcgatttactggggcaaggggttcccattggtggcattggcattcaagcccatttggaatatcccttggatgcagccaagatgaaacgcgcccttgatacccttgcccaattcaacctgcccctaaaaatcactgaagttagtgtcagccttgccgacgagcagcagcaggcggagacactgcgccaaatctaccgcattggttttgcccatccagccgtcaaagagatcctcctgtggggattttgggaaggcaaccactggcgaccccaagcaggactgtaccgtcgcgacttttccgccaaacctgctgccgaagcctatcgacaactcctctttcaggagtggtggaccaccagcaacggcaaaactaatgccgatgggcgctggcagacccgcggctatgcggggcgctatcgcctcacagtaacggccaacggccagaccattaaccgcgacattgacctaccagacttggagagaaccgtgaccgtacaattcccatga

SEQ ID NO: 332 - protein, 413 aa, Unknown
  Obtained from an environmental sample.
  SIGNAL (1)...(28)
MFKGLRYLLLLCLSAGLVFACAPRSVTAPPDGLSGQIRLLRQGTLTVLVQNAQGQPIANAKVVAAQQTHAFPFGVALDTAMFEPSPPPAANWYRNTARQNFNAAVHENALKWYALEPEQGKLDFTMADRILAWSEAQGWPMRGHTLFWEVEQFNPPWLKTLPPEQLRAAVKNHAMTVCRHYRGRINEFDVNNEMLHGNFFRSRLGNGIVKEMFEWCREGNPEAVLYVNDYGIIEGDRLDDYVQQIRDLLGQGVPIGGIGIQAHLEYPLDAAKMKRALDTLAQFNLPLKITEVSVSLADEQQQAETLRQIYRIGFAHPAVKEILLWGFWEGNHWRPQAGLYRRDFSAKPAAEAYRQLLFQEWWTTSNGKTNADGRWQTRGYAGRYRLTVTANGQTINRDIDLPDLERTVTVQFP

SEQ ID NO: 333 - DNA, 1152 bp, Unknown
  Obtained from an environmental sample.
atgaaaagacaatttattggacgattgagacttgtcactatcctttcaatcatagtgattatgggatgtgcttcaaacaaaagtgatcagaatgttgataacctaaaggacgccttcgacggtttgttccttattggaactgccatgaataccccccagatcaccggacaggatacccggacgcttgaattgatcaaaaaacacatgaactccattgtggcagaaaacgttatgaaaagcggactaatacagcccagcgaaggggagttcgacttctcacttgccgaccagtttgtgcaattcggtgttgacaacaacatgcacatcgtagggcatacccttatctggcattcgcaggctccagggtggttttttgtggatgaaaacggtaatgatgttagtcccgaagttcttaagcaaaggatgaaagaccacatctacacagtagttggccgttacaaaggcaaagtgcacggttgggatgtggtgaatgaatgtatcgttgacgatgggtcatggcgcaacagcaagttttaccagatcctgggtgaagactttgtaaagtatgccttccagtttgcttcagaagccgacccgaatgctgaattgtattacaacgattattccatggcacttcccggccgccgccagggagtcgtaaacatggtaaaaaatctacaggcacaaggtattaaaattgacggaataggaatgcagggccacctgatgatcgaccatccatcccttgaagatttcgaaaccagtttgcttgcctttgccgatctgggtgtacatgttatgatcactgagcttgatgtatctgtacttccttttcctacccgcaacctcggtgctgatgtatctctaaacatagcttacaacactgaactgaacccctatcccgatggattgcctgatgatgtggcccaaaaacttcatgatcgctggctcgatatatatcgtttatttataaaacatcacgacaagatcacccgtgttactacctggggtacagccgatggtatgtcatggaagaacaactggcccattcgtggacgcacagactttcctttattattcgaccgcgattttcaacccaaaccggtagtagctgatattatcaaagaagcattggctgcaaagagaaaatag

SEQ ID NO: 334 - protein, 383 aa, Unknown
  Obtained from an environmental sample.
  SIGNAL (1)...(30)
MKRQFIGRLRLVTILSIIVIMGCASNKSDQNVDNLKDAFDGLFLIGTAMNTPQITGQDTRTLELIKKHMNSIVAENVMKSGLIQPSEGEFDFSLADQFVQFGVDNNMHIVGHTLIWHSQAPGWFFVDENGNDVSPEVLKQRMKDHIYTVVGRYKGKVHGWDVVNECIVDDGSWRNSKFYQILGEDFVKYAFQFASEADPNAELYYNDYSMALPGRRQGVVNMVKNLQAQGIKIDGIGMQGHLMIDHPSLEDFETSLLAFADLGVHVMITELDVSVLPFPTRNLGADVSLNIAYNTELNPYPDGLPDDVAQKLHDRWLDIYRLFIKHHDKITRVTTWGTADGMSWKNNWPIRGRTDFPLLFDRDFQPKPVVADIIKEALAAKRK

SEQ ID NO: 335 - DNA, 849 bp, Unknown
  Obtained from an environmental sample.
atgattccaaggatcgtcctggccgtccgcatatcccctacttttctcagcccacaaaaaggggtaataaaaatgataaagcgggcttttatgataaccctggcggccttcctcctccttttcgccctaaattccctgcctatccatgccggggccgaaggcggggaggaaaagtttacccccaaggtcatcgtggagcacggtttcgagaataacgacttccacggttgggtcccccggggcggggtcgggaccatttccattaccaatgaggcggcccatagcgggtcctcctgcctgaagatcaccggccggactcaagcttggcatatgccgcgggtggagatcaccaagtacttagaaaagggagctaagtataagatcgaattgtacgtcaagctccccgcgggcacctcgccgcgcaagttccagctggcggttctcacccgttatctcgaaggcaaccagaccagggacaaagaggactccatctcggacgaggtggaggtgaccgccgatacctggaccaaggtcgagggcgagtacgtcttcgacccggcggccatcggcgcctacgtctacccctacctcaagggcgaccccgcaggggcctatgccccctatctcatcgatgatttcaagatcaccacgatcgcccccgcccccaagaagaccgccgctaccgccgcggcaaaagaggcagaagagcccttaatcgagaccgatataccatccttaaaagacgtctgcgcgtcctacttcgagatcggcgcggccatcgagccatatgagttattctccaagccccacgatcagctgctccggaaacatttcaacaccgttggttga

SEQ ID NO: 336 - protein, 282 aa, Unknown
  Obtained from an environmental sample.
  SIGNAL (1)...(50)
MIPRIVLAVRISPTFLSPQKGVIKMIKRAFMITLAAFLLLFALNSLPIHAGAEGGEEKFTPKVIVEHGFENNDFHGWVPRGGVGTISITNEAAHSGSSCLKITGRTQAWHMPRVEITKYLEKGAKYKIELYVKLPAGTSPRKFQLAVLTRYLEGNQTRDKEDSISDEVEVTADTWTKVEGEYVFDPAAIGAYVYPYLKGDPAGAYAPYLIDDFKITTIAPAPKKTAATAAAKEAEEPLIETDIPSLKDVCASYFEIGAAIEPYELFSKPHDQLLRKHFNTVG

SEQ ID NO: 337 - DNA, 870 bp, Unknown
  Obtained from an environmental sample.
atgaagcccgacagcgtgctggatgtaaacgccagcaaaaagctctccgcccaggatgaaaccgccgtggcggtgaaattcgacgccgcccgcgccctgctggattttgtcaaggaaaacgggctcaaggtgcacggtcacgtgctggtatggcattcccagacgccggaagccttcttccacgagggctatgatgccgccaggccctacgtggggcgggacgtgatgctggggcgcatgaaaaactacatcaaggccgtgtttgaatacactgagaccaattaccccggcgtcatcgtctcctgggacgtagtgaacgaagccatcgacgacggcaccaacaagctgcgccagtccaactggttcaaaaccgttggcgaggatttcgtgctccgcgcctttgaatacgccaggaaatacgcccccgaaggcacgctgctttattacaacgattacaacaccgccatgcccggcaagctgaacggcatcgccaatctgctcaaagccctcatcgccgagggcaacatcgacggctacggcttccaaatgcaccacagcgtgggcttcccctccatggaaatgatttccgcgtctgtggagcgcatcgccggcatgggccttaagctccgggtcagcgaattggacgtgggcaccgacggaaacaccgaaagcagcttcaccaagcaggcggaaaaatacgccgccatcatgcggctgctgctggattataaggatcaaatggaagccgtgcaggtatggggcctcaccgacgatatgagctggcgccgggccaactatcccctgctcttcgacggcaaattcaaccccaagcccgccttctacgccgtggctgacccatacgcaaaataa

SEQ ID NO: 338 - protein, 289 aa, Unknown
  Obtained from an environmental sample.
MKPDSVLDVNASKKLSAQDETAVAVKFDAARALLDFVKENGLKVHGHVLVWHSQTPEAFFHEGYDAARPYVGRDVMLGRMKNYIKAVFEYTETNYPGVIVSWDVVNEAIDDGTNKLRQSNWFKTVGEDFVLRAFEYARKYAPEGTLLYYNDYNTAMPGKLNGIANLLKALIAEGNIDGYGFQMHHSVGFPSMEMISASVERIAGMGLKLRVSELDVGTDGNTESSFTKQAEKYAAIMRLLLDYKDQMEAVQVWGLTDDMSWRRANYPLLFDGKFNPKPAFYAVADPYAK

SEQ ID NO: 339 - DNA, 1125 bp, Unknown
  Obtained from an environmental sample.
atgcctatggagcgacccactttcttgcggtttcttgccttttttcttctttttaccatgattttcgccgccggagggtgccgaccccttgccccttcacggatggagatcgagacggatatcccctccctcaaggaagtcgccgcttcttatttcgagatcggcgcggccgtcgagccgtatcagttatcctctccaccccacgatgcccttctgcggaaacattttaactgcctcgtggcggagaacgtcatgaagcccgcctccatccagccatcggaggggtatttcaactggaccgaagcggacaagatcgtgaactacgccaaagcccacgggatgaagctccgcttccataccctcgtctggcataatcaggtcccggattggttcttcgcgggtaacgacaaaacccgccttttgcagcgcttggagaatcatatccggactatcattaaaagatatggcgataaggtcgactattgggacgtggtgaacgaagtaatagacgacaacggcggtatgcgaaacagcaagtggtaccagatcaccgggaaggactacatcaagaccgccttccgggtggcagacgacgagctcaggaagaatgggtggaggaaagaaggtcgtcagctctatatcaacgactacaacacccataacccaacgaagagagaggggatctggcgcttgatccaagagctccgggcggaagggattcccgtcgacggagtaggccaccagacgcatatcaatatcgaatggccgcccgtaagccagatcgtggaatcgatccgcttcttcggcgaaaaaggcctcgataaccaggtgaccgagctggatgtgagcatctatacgaatgacaaggattcacatggtagttatcaggccatcccgcaggaagtcttcatcaagcagggtaatcgctacaaggaactctttgaagggctaaaaagtgtaaaaaactacctcagcaacgtcaccttctggggcatggcggacgatcatacctggctgaaccgttggcccatcgaacggcccgatgctcctcttcctttcgatatctatctcaaggccaagccggcgtattgggggatcgtggatgctttgaagctttcgcggtga

SEQ ID NO: 340 - protein, 374 aa, Unknown
  Obtained from an environmental sample.
  SIGNAL (1)...(23)
MPMERPTFLRFLAFFLLFTMIFAAGGCRPLAPSRMEIETDIPSLKEVAASYFEIGAAVEPYQLSSPPHDALLRKHFNCLVAENVMKPASIQPSEGYFNWTEADKIVNYAKAHGMKLRFHTLVWHNQVPDWFFAGNDKTRLLQRLENHIRTIIKRYGDKVDYWDVVNEVIDDNGGMRNSKWYQITGKDYIKTAFRVADDELRKNGWRKEGRQLYINDYNTHNPTKREGIWRLIQELRAEGIPVDGVGHQTHINIEWPPVSQIVESIRFFGEKGLDNQVTELDVSIYTNDKDSHGSYQAIPQEVFIKQGNRYKELFEGLKSVKNYLSNVTFWGMADDHTWLNRWPIERPDAPLPFDIYLKAKPAYWGIVDALKLSR

SEQ ID NO: 341 - DNA, 1347 bp, Unknown
  Obtained from an environmental sample.
atgacaattaacaacaaaactacagcgagtcctagtattcccagcacccacaattccctcccgtcgcttcgcacactgtttaccaccagcctgctcacgctggccctgaccgcctgcggtggttcttccagcagcgacaaggacccttcaagctccagctccagtgaatcatcaagttccagcgaatcctcgagctcagcttccagcgaatcctcgagcagtgagtccagcagtagctcttccgcgggccatttctccatcgagccggacttccagctctacagcctggccaacttcccggtgggcgtggcggtctccgccgccaacgagaacgacagcatcttcaacagtccggatgccgccgaacgtcaggccgttattattgagcacttctctcagctcaccgccggcaacatcatgaaaatgagctacctgcagccgagtcaaggcaacttcaccttcgatgacgccgacgagttggttaacttcgcccaagccaatggcatgaccgtacacggccactccaccatctggcacgcggactaccaagtaccgaacttcatgagaaactttgaaggtgaccaggaggaatgggcagaaattctgaccgatcacgtcactaccatcatcgagcacttccccgacgatgtggtcatcagctgggacgtggtgaacgaggctgtcgatcaaggcacggcgaacggctggcgccattcggtgttctacaatgcattcgacgccccggaagaaggcgacattcccgaatacatcaaagtcgctttccgcgccgcgcgcgaggctgacgccaacgtagacctctactacaacgactacgacaataccgccaatgcccagcgcctggccaaaacactgcaaattgccgaggtactggacgccgaaggcaccattgacggcgtcggtttccagatgcacgcctacatggattacccgagcctgacccattttgaaaacgccttccggcaagtcgtcgacctggggctcaaagtgaaagttaccgagctggacgtatccgtagtcaacccctacggcggcgaagcacctccacaaccggaatacgacaaagaactggccggcgcgcaaaaactgcgcttctgccaaatcgccgaagtttacatgaacactgtacccgaggagttacgcggtggcttcaccgtctggggcctgaccgatgatgaaagttggctgatgcaacagttcagaaacgccaccggcgccgactacgacgacgtctggccgttactgttcaatgccgacaaatccgccaaaccggcactgcaaggcgtggccgacgcctttaccggacaaacctgcacctccgagttctaa

SEQ ID NO: 342 - protein, 448 aa, Unknown
  Obtained from an environmental sample.
  SIGNAL (1)...(45)
MTINNKTTASPSIPSTHNSLPSLRTLFTTSLLTLALTACGGSSSSDKDPSSSSSSESSSSSESSSSASSESSSSESSSSSSAGHFSIEPDFQLYSLANFPVGVAVSAANENDSIFNSPDAAERQAVIIEHFSQLTAGNIMKMSYLQPSQGNFTFDDADELVNFAQANGMTVHGHSTIWHADYQVPNFMRNFEGDQEEWAEILTDHVTTIIEHFPDDVVISWDVVNEAVDQGTANGWRHSVFYNAFDAPEEGDIPEYIKVAFRAAREADANVDLYYNDYDNTANAQRLAKTLQIAEVLDAEGTIDGVGFQMHAYMDYPSLTHFENAFRQVVDLGLKVKVTELDVSVVNPYGGEAPPQPEYDKELAGAQKLRFCQIAEVYMNTVPEELRGGFTVWGLTDDESWLMQQFRNATGADYDDVWPLLFNADKSAKPALQGVADAFTGQTCTSEF

SEQ ID NO: 343 - DNA, 2217 bp, Unknown
  Obtained from an environmental sample.
atggtggagcacgaagctgagcttcatgattaccgcgaacgaatatgcgaagttgcttggcaattcgctgggcctggagggcgagaaggcaaagcggattttgcgggaaatcaacaactggctgttttgaagatgaaattatcgagagggagggggcatggcgttttgaaacgagcaggtctgattgggcttattgcagcgatattgggctgcgcggcgctgcttatgcacaatgagatctcatccctgggaattcagctgagatcatggctcagagggagcgacaatgtgaacgctagctgggaaaaggattggaagacggctgctaacgagcaaatcgagcagctccgcaagcgcaatgtggagatcgaggtcgtcgatctgaacggaaacccgctgcctggggctaccgttcgcgcggttcagcgcacgcatcagtttggcttcggcaccgccatcaaccgaacggcgttgagcaatccggtgtacgccgattttgtcaaaaaccgtttcgaatgggtgaccttcgagaacgaggccaagtggctctggaatgaggccgtacaagggcgggtctattatcgggaggccgatcagctgctcgaatttgccaggcaaaacgggctgaaggtgcgcggacataatctgttctgggaggcggagaaatatcagccgcagtgggtgaagagtctgacgggcgctgcgctgaaggaagcgatcgataaccggctgaacagcgccgtcctgcattttaagggcaattttctgcactgggacgtcaacaacgaaatgtttcacggcagcttcttcaaggatcgcctgggggaagaaatctggacctatatgtataagcgaacccgggaactcgatcccggcgtcaagctgttcgtcaacgattacaattttatcgagtacccgccggagcgggattataaccaggtcattcaagcgctcatcgatcgggggatgccgattgacggcatcggcgcgcaagggcattttaacggagtcatcgatcccttgttcgttaagggaagactggataagctggctgagctgaatctgccgatctggattaccgaattcgattccacgcataaggacgagagagtccgtgccgataatctggagaagatgtatcggctggcgttcgcccatccggcggtcgaagggattgtcatgtggggcttctgggcgggctcccattggaagggcactgacggcgcgatcgtgaatcaagactggacgctcaatgccgccggacagcgataccagcagcttatggatgaatggacgacggtcgtcgaaggcacgaccgatcagcgcggcatgttttcgttccgggggttccacggaacctacgatatgctggtcgattaccctggagcggcggctgtgaagcagtcctttaccttggagcccggctctggcaatgcgaagctgcacattccgttcgacgttcaggacaagtccatcccggaggctcctgccaagctcagcgccgctgccgcggattcccaggttatgctgagctggagcaaggtcaacggggcaaccggctatacggttaaaagcgcggtcagcgccgacggtccctatacgccgattgcccatcagctgctcaccgagaccttcacgcacatcggtctagtgaaccggaaagattattattacgtggtgagcgccagcaaccatctaggtgagagcccggattccgccccgatccgggccactccgcgtgccgcgggcgagttacaaacgaatctcgtgcttcagtaccgctccgctgatggagataacaactatcaaatgaagcctcagttcacgatcaagaacgcaggcaaagtgcccatcccgttaagcgagctgacgatccgctactatttcacgccggagagcacgcagccggtggataccaggatcgactgggcccaattcggagcagagcatgtccagacgacggtcgttccgccatccgatgccgcggcgcacgcctatgtcgagctcagcttcctggagtcggcaggggccatcccttccgatacgacattaggcaatattcagctgcgcatctttaacagcgatggctcttcgttcgataaaacgaacgattattccttcgacccgacgaaaaaggcttatacggcgtgggagaaggtcacgctttatcggaacggggaactggtttgggggatagagccttggggcgcgaagtaa

SEQ ID NO: 344 - protein, 738 aa, Unknown
  Obtained from an environmental sample.
MVEHEAELHDYRERICEVAWQFAGPGGREGKADFAGNQQLAVLKMKLSRGRGHGVLKRAGLIGLIAAILGCAALLMHNEISSLGIQLRSWLRGSDNVNASWEKDWKTAANEQIEQLRKRNVEIEVVDLNGNPLPGATVRAVQRTHQFGFGTAINRTALSNPVYADFVKNRFEWVTFENEAKWLWNEAVQGRVYYREADQLLEFARQNGLKVRGHNLFWEAEKYQPQWVKSLTGAALKEAIDNRLNSAVLHFKGNFLHWDVNNEMFHGSFFKDRLGEEIWTYMYKRTRELDPGVKLFVNDYNFIEYPPERDYNQVIQALIDRGMPIDGIGAQGHFNGVIDPLFVKGRLDKLAELNLPIWITEFDSTHKDERVRADNLEKMYRLAFAHPAVEGIVMWGFWAGSHWKGTDGAIVNQDWTLNAAGQRYQQLMDEWTTVVEGTTDQRGMFSFRGFHGTYDMLVDYPGAAAVKQSFTLEPGSGNAKLHIPFDVQDKSIPEAPAKLSAAAADSQVMLSWSKVNGATGYTVKSAVSADGPYTPIAHQLLTETFTHIGLVNRKDYYYVVSASNHLGESPDSAPIRATPRAAGELQTNLVLQYRSADGDNNYQMKPQFTIKNAGKVPIPLSELTIRYYFTPESTQPVDTRIDWAQFGAEHVQTTVVPPSDAAAHAYVELSFLESAGAIPSDTTLGNIQLRIFNSDGSSFDKTNDYSFDPTKKAYTAWEKVTLYRNGELVWGIEPWGAK

SEQ ID NO: 345 - DNA, 849 bp, Unknown
  Obtained from an environmental sample.
atgaagatgacctacatgcatccggctgaagatacttactcgtttggtcaagcggatcagttggtcaactgggcgaaagcgaatggtattggcgtgcacggccacactctggtttggcactccgaataccaggtacccaattggatgaaaaattactctggtgatgcaactgcattccaaaccatgctcaacacccatgtgaaaactgtggctgagcattttgctggcgaactggacagctgggacgttgtgaatgaagtgctggagccgggctccaatggttgctggcgtgaaaactctctgttctaccagaagcttggcaaagactttgtcgcgaacgcattccgtgcagctcgcgagggcgatcccaatgcagacttgtattacaacgattactcgactgaaaatggtgtaacttccgatgagaagttcagttgtttgttggaactagtcgatgagcttctggaagcggacgtgccgattacaggtgttggtttccaaatgcacgtgcaggcgacgtggcctagcaatgccaacatcggcaaggcattcaaagccatcgcggatcgcggtctgaaagttaaaatttctgagctcgatgttcctgttaacaacccttacggaaccactaatttcccgcaatacagcagttttaccgcggaagccgccgagctgcagaagcagcgctacaagggcattatgcaagcgtaccttgataacgtaccggccaacctgcgtggtggtttcaccgtgtggggcgtttgggatggcgatagctggatcatgacgttcagccagtacaccaacgctaacgccaacgactggccactgttgttcaccgggccgtag

SEQ ID NO: 346 - protein, 282 aa, Unknown
  Obtained from an environmental sample.
MKMTYMHPAEDTYSFGQADQLVNWAKANGIGVHGHTLVWHSEYQVPNWMKNYSGDATAFQTMLNTHVKTVAEHFAGELDSWDVVNEVLEPGSNGCWRENSLFYQKLGKDFVANAFRAAREGDPNADLYYNDYSTENGVTSDEKFSCLLELVDELLEADVPITGVGFQMHVQATWPSNANIGKAFKAIADRGLKVKISELDVPVNNPYGTTNFPQYSSFTAEAAELQKQRYKGIMQAYLDNVPANLRGGFTVWGVWDGDSWIMTFSQYTNANANDWPLLFTGP

SEQ ID NO: 347 - DNA, 1794 bp, Unknown
  Obtained from an environmental sample.
atgcccgttttgttcgccctgtttcttgttgcctcgtcctgcgcggcgcagtcgctggccgggccggtttccctgcttggcggagatgcgggcgcggcgttccgctataccgggccatcggcgggcgcggcgagcggctcggccgaatgggtggcggtggagaacatgccgttcacgcacgcctggcggctgcgcacgaatccgctgccggagagcggcggcaacgaatgggacctgcgcatccgcgcccgcggagcggcggctgtttcggcaggggacaagatcctggccgagttctggatgcgctgcgtggagcccgaaaacggcgactgcattctgcgcctgaacgtggagcgcgacgggtcgccgtggaccaaatccatcagcaacccctacccggtgggccgggagtggcggcggttccgcgtgctgttcgagatgcgggagagctacgccgccggcggctacatgatcgatttctggatgggccagcaggtgcagacggcggaagtgggcgggatttccctgctgaattacggtccgcaggccacggccgagcagcttggcctggaccggttttatgagggcgcggcggcggacgccgcgtggcggcaggcggccgagcagcggatcgaggagatccggaaagcgggcatgatcatcgtggcggtgacgccggacggcgagccgatcgagggcgctgaaatccgggcgaagctgaagcggcacgcgttcgggtggggcacggctgtggcggcatcacggcttctggggacgggaacggacagcgagcgctaccgcaacttcatccgcgagaacttcaacatggcggtgctcgagaacgacctgaaatggggcccgttcgaagagaaccgcaaccgcgcgatgaacgcgctgcgctggctgcatgagaacgggatcacgtggatccgcgggcacaatctcgtctggccgggctggcggtggatgccgaacgacgtgcgcaacctggcgaacaatcccgaggcgctgcggcagcggattctggaccgcatccgggacacggccacggccacgcgcgggctggtggtgcactgggacgtcgtcaacgagccggtggccgagcgcgacgtgctgaacattctgggcgacgaggtgatggcggactggttccgcgccgcgaaggagtgcgatcccgaggcgaggatgttcatcaatgagtacgacattctggcggcgaacggggccaatctgcggaagcagaacgcgtattaccgcatgatcgagatgctgttgaagctcgaggcgccggtggagggcatcggcttccagggccacttcgacacggccacgccgccggagcggatgctggagatcatgaaccggtacgcccggctcgggctgccgatcgccatcaccgagtacgatttcgccacggcggacgaggagctgcaggcgcagttcacgcgcgacctgatgattctcgccttcagccatccggcggtttcggacttcctgatgtggggcttctgggaagggagccactggaagccgctgggcgccatgatccggcgcgactggagcgagaagccgatgtaccgcgtctggcgcgagctgatcttcgagcgctggcagacggatgaaacaggcgtgacgccggagcacggtgccatctacgtgcggggcttcaagggcgactacgagatcacggtgaaggcgggcgggcaggaagtccgggtgccgtacacgctgaaagaagacggccaggtgctgtgggtgacggtgggcggggcttctgaagagcgcgtgcagtaa

SEQ ID NO: 348 - protein, 597 aa, Unknown
  Obtained from an environmental sample.
  SIGNAL (1)...(20)
MPVLFALFLVASSCAAQSLAGPVSLLGGDAGAAFRYTGPSAGAASGSAEWVAVENMPFTHAWRLRTNPLPESGGNEWDLRIRARGAAAVSAGDKILAEFWMRCVEPENGDCILRLNVERDGSPWTKSISNPYPVGREWRRFRVLFEMRESYAAGGYMIDFWMGQQVQTAEVGGISLLNYGPQATAEQLGLDRFYEGAAADAAWRQAAEQRIEEIRKAGMIIVAVTPDGEPIEGAEIRAKLKRHAFGWGTAVAASRLLGTGTDSERYRNFIRENFNMAVLENDLKWGPFEENRNRAMNALRWLHENGITWIRGHNLVWPGWRWMPNDVRNLANNPEALRQRILDRIRDTATATRGLVVHWDVVNEPVAERDVLNILGDEVMADWFRAAKECDPEARMFINEYDILAANGANLRKQNAYYRMIEMLLKLEAPVEGIGFQGHFDTATPPERMLEIMNRYARLGLPIAITEYDFATADEELQAQFTRDLMILAFSHPAVSDFLMWGFWEGSHWKPLGAMIRRDWSEKPMYRVWRELIFERWQTDETGVTPEHGAIYVRGFKGDYEITVKAGGQEVRVPYTLKEDGQVLWVTVGGASEERVQ

SEQ ID NO: 349 - DNA, 1794 bp, Unknown
  Obtained from an environmental sample.
atgcccgttttgttcgccctgtttcttgttgcctcgtcctgcgcggcgcagtcgctggccgggccggtttccctgcttggcggagatgcgggcgcggcgttccgctataccgggccatcggcgggcgcggcgagcggctcggccgaatgggtggcggtggagaacatgccgttcacgcacgcctggcggctgcgcacgaatccgctgccggagagcggcggcaacgaatgggacctgcgcatccgcgcccgcggagcggcggctgtttcggcaggggacaagatcctggccgagttctggatgcgctgcgtggagcccgaaaacggcgactgcattctgcgcctgaacgtggagcgcgacgggtcgccgtggaccaaatccatcagcaacccctacccggtgggccgggagtggcggcggttccgcgtgctgttcgagatgcgggagagctacgccgccggcggctacatgatcgatttctggatgggccagcaggtgcagacggcggaagtgggcgggatttccctgctgaattacggtccgcaggccacggccgagcagcttggcctggaccggttctatgaaggcgcggcggcggacgccgcgtggcggcaggcggccgagcagcggatcgaggagatccggaaagcgggcatgatcatcgtggcggtgacgccggacggcgagccgatcgaaggcgccgagatccgggcgaagctgaagcggcacgcgttcgggtggggcacggcggtggcggcatcacggcttctggggacgggaacggacagcgagcgctaccgcaacttcatccgcgagaacttcaacatggcggtgctcgagaacgacctgaaatggggcccgttcgaggagaaccgcgcccgcgcaatgaacgcgctgcgctggctgcatgagaacgggatcacgtggatccgcgggcacaatctcgtctggccaggctggcggtggatgccgagcgacgtgcgcaacctggcgaacaatcccgaagccctgcggcagcggattctggaccgcatccgggacacggccaccgccacgcgcgggctggtcgtgcactgggacgtcgtcaacgagccggtggccgagcgcgacgtgctgaacattctgggcgacgaggtgatggcggactggttccgcgccgcgaaggagtgcgatcccgaggcgaggatgttcatcaacgaatacgacattctggcggcgaacggggccaacctgcggaagcagaacgcgtactaccgcatgatcgagatgctgttgaagctcgaggcgccggtagagggcatcggcttccagggccatttcgacacggctacgccgccggagcggatgctggagatcatgaaccggtacgcccggctcgggctgccgatcgccatcaccgagtacgatttcgccacggtagacgaagagctgcaggcgcagttcacgcgcgacctgatgattctcgctttcagccatccggcggtttcggacttcttgatgtggggcttctgggaagggagccactggaagccgctgggcgccatgatccggcgcgactggagcgagaagccgatgtaccgcgtctggcgcgagctgatcttcgagcgctggcagacggatgaaacgggagtgacgccggagcacggggccatctacgtgcggggcttcaagggcgactacgaaatcacggtgaaggctggcgggcaggaagtccgggtgccgtacacgctgaaagaagacggccaggtgctgtgggtgacggtgggcggtacttctgaagagcaggcgccgtaa

SEQ ID NO: 350 - protein, 597 aa, Unknown
  Obtained from an environmental sample.
  SIGNAL (1)...(20)
MPVLFALFLVASSCAAQSLAGPVSLLGGDAGAAFRYTGPSAGAASGSAEWVAVENMPFTHAWRLRTNPLPESGGNEWDLRIRARGAAAVSAGDKILAEFWMRCVEPENGDCILRLNVERDGSPWTKSISNPYPVGREWRRFRVLFEMRESYAAGGYMIDFWMGQQVQTAEVGGISLLNYGPQATAEQLGLDRFYEGAAADAAWRQAAEQRIEEIRKAGMIIVAVTPDGEPIEGAEIRAKLKRHAFGWGTAVAASRLLGTGTDSERYRNFIRENFNMAVLENDLKWGPFEENRARAMNALRWLHENGITWIRGHNLVWPGWRWMPSDVRNLANNPEALRQRILDRIRDTATATRGLVVHWDVVNEPVAERDVLNILGDEVMADWFRAAKECDPEARMFINEYDILAANGANLRKQNAYYRMIEMLLKLEAPVEGIGFQGHFDTATPPERMLEIMNRYARLGLPIAITEYDFATVDEELQAQFTRDLMILAFSHPAVSDFLMWGFWEGSHWKPLGAMIRRDWSEKPMYRVWRELIFERWQTDETGVTPEHGAIYVRGFKGDYEITVKAGGQEVRVPYTLKEDGQVLWVTVGGTSEEQAP

SEQ ID NO: 351 - DNA, 1860 bp, Unknown
  Obtained from an environmental sample.
atgcaccttccaaattaccgctcgctcgcaacggcgctcagtcgctacagttgctcggcgctgctggccgtcagtcttgtggcctgcgggggcaataatgaccaagatccgccgaccccggagccaactccggtcccaacgccgactccaactccaaccccgaccccgactccggagccaaccccgactccgactccggagcccactccgactccagagccaactccgacgccgaccccggaaccaacaccgacgccggagccgacgccaacaccggatcccggggccgactaccagccgcccagcaatgacattgccgtcaatggcgacgtggaaagcggtactaccaactggggtgcacgcggttcggcatccattagccgagtcactttagagagctttgaaggtgatgccagcttgagtgttaccggccgagaagacgactggcatggcgccaccttctctgtaggccatctgaccccgggtaatagctatgaagtggctgcgtgggtcaagttagcctcaggcgagcccaacacagtggtcaaaatcacgggtaagcgcgagggcgagagcgcgacttacgaagagtacacggatgtcggtacggcattggctaccgacggtagctggaccgaaattaccggcacttatattcctgatagcgccagcccatttgaatattttattgtggagacccaagagggtggaccgaccgttagcttctacgtggacgcgttttcagtggccggtgaggtggaagatacgccagcgccaacgccgcccccaaccgctccgccaccgagtggctcaggcctagcggaactagtggatttcccggtgggcgttgccgttgcggtagctagttttgccaataacgatttcctgagtaacacgcaacaacaagatatcgtgcttaacaattttagtgaaattgttgcggagaatcagatgaagatggaatatttcaacgatgactactccaaccccagggcagatcaactggtcagctgggccaatgagcgaggtattcgggttcacggccacgctttggtctggcacgcgcaagcagcgtcatgggtcagtcctccggtaagcaactttcgcgagcgttatgtcaaccatgttcgtggtgtggcatcccggtatgcggacacggtagtaagctgggatgtcgtcaatgaagctttgaccgatgatgatgtctccccgggtggaagctactaccggcaatctgagttctaccgacagttcaatggcccagagttcattgatatcgctttccgtgaagctcgagaggcagcccccaatgcgctgctttactacaacgactacaatattgagaacggactggacaaaaccgatggtttgattcagctacttgagaggttgagggataatgacgtgcccattgatggcgtgggcttccaaatgcatgttttgttggattggcccgatatcagcactattcgacgttcctgggagcgcgcattagcggttgaccccgatgaccgtatgcttttaaaaataacggaactcgatgtgcgtatcaacaatccctacgacgataatctcgaaagaggcatcgttcactccagccggggtgactgcgatgacatttccggggtctgcgaaggctttgagcggcaagccgctcgttaccgggagattattgaggcctactttgacgtcgtgccaccgcaccgccgaggtggcatcagtgtttggggtattgccgaccattatagttggtattatacccatgaaggctatgtcgattggccccttttgtgggacaggaacctacagccaaagcctgcttacaacgctgtttatgaagctctgcagcagggccaataa

SEQ ID NO: 352 - protein, 619 aa, Unknown
  Obtained from an environmental sample.
  SIGNAL (1)...(73)
MHLPNYRSLATALSRYSCSALLAVSLVACGGNNDQDPPTPEPTPVPTPTPTPTPTPTPEPTPTPTPEPTPTPEPTPTPTPEPTPTPEPTPTPDPGADYQPPSNDIAVNGDVESGTTNWGARGSASISRVTLESFEGDASLSVTGREDDWHGATFSVGHLTPGNSYEVAAWVKLASGEPNTVVKITGKREGESATYEEYTDVGTALATDGSWTEITGTYIPDSASPFEYFIVETQEGGPTVSFYVDAFSVAGEVEDTPAPTPPPTAPPPSGSGLAELVDFPVGVAVAVASFANNDFLSNTQQQDIVLNNFSEIVAENQMKMEYFNDDYSNPRADQLVSWANERGIRVHGHALVWHAQAASWVSPPVSNFRERYVNHVRGVASRYADTVVSWDVVNEALTDDDVSPGGSYYRQSEFYRQFNGPEFIDIAFREAREAAPNALLYYNDYNIENGLDKTDGLIQLLERLRDNDVPIDGVGFQMHVLLDWPDISTIRRSWERALAVDPDDRMLLKITELDVRINNPYDDNLERGIVHSSRGDCDDISGVCEGFERQAARYREIIEAYFDVVPPHRRGGISVWGIADHYSWYYTHEGYVDWPLLWDRNLQPKPAYNAVYEALQQGQ

SEQ ID NO: 353 - DNA, 1983 bp, Unknown
  Obtained from an environmental sample.
atggtttgctcggccgccctcggggcgaccgccgtcagtgcccaaaccttgagcaacaactcaaccggtaccaacaacggtttctactacaccttttggaaggactcgggcagcgcgaccatgaccctcgcagcgggtggtcgttacacctcccaatggaccaacaacaccaataactgggtgggtggtaaaggctggaacccgggcaatagcacccgcgtgatcagctattccggtaactatggcgtcagcaatagccaaaattcctacctggccttgtacggctggacccgcagcccgctgattgaatactacgtgatcgaaagctacggctcctacaacccggcatcctgctctggcggtaccaatatgggtagcttccagagtgatggcgcgacctacgatgtgcgccgttgccagcgcgtgcaacagccatccatcgatggcacccaaaccttctaccaatatttcagcgtgcgcaatccgaaaaaaggcttcggccaaatttccggcaccatcacctttgctaaccacgcagccttttgggcgagcaagggcatgaacctgggtgcccataactatcaagtaatggcgaccgagggttatcaaagtaccggcagttccgatatcacagtgagtgaaggccccatcaacggcggcaccagcagcacgcccccggtaacaaccagcagcagtgccagctcagtggcaacgggcggtggtaacaccggtagtggcgtagtggtgcgcgcgcgcggcgtcgcgggcggcgagcatattaacctgcgtatcggtggcaataccgtcgccagctggaacctcaccaccagcttccaggatctcagctacagcggcaccgcgtcgggcgatatccaggtgcaatatgacaacgacggcggcagccgcgatgtcgtagtggattacatccgcgttaacggcgaaacccgccaggcggaggatatgagctacaacaccgccttgtacgcgaatggttcctgcggtggcggcggcaattccgaactgatgcactgcaatggcgtgatcggttttggctacacctatgattgcttcagcggcaactgctccggcggcagcacggggggtggcaacactggcaccagcagcagcgcggcgagcgccggtggtggcaacagcaactgctccggctatgttggtattactttcgacgatggcccaaccgctaacactcccaccctggttaacctgttgaagcaaaacaacctgacgccggtaacctggttcaaccagggcaacaacgtggttgccaatgccaattacatggcccagcaattgagcgttggtgaagtacataaccacagctacagccatccgcaaatgggcagcatgacctaccaacaggtttatgacgagttgaaccgtgccaaccaggctatccaaaccgcgggtgcacccaagccaaccctgttccgcccaccttatggcaccgttaactccaccatccaacaagcggcccaggccttgggtttgcgggtgatcacctgggatgtggattcgcaagactggaatggcgccactgcctcggccatcgccagcgcagctaaccgcctgacaaacggccaggtaatcctgatgcacgacggcagctacaccaacaccaatgccgctattgcccagatcgcctccagcctgcgcgccaagggcttgtgcccgggtcgtatcgatccggcaaccggccgagccgttgctcctgcgggtggcaatactggcggcggtactgtgtcaagcagcactcgcagcagcactccggtagtggtaagcagcagccgtagcagcagtagtgttgccgctggcggcgcctgccaatgcaattggtggggcacccgttacccgatctgtacgtccactgccagtggttggggttgggagaacaaccgcagctgtatcaccaccagcacctgtaacagtcagggccctggcggtggtggggtagtgtgtaactaa

SEQ ID NO: 354 - protein, 660 aa, Unknown
  Obtained from an environmental sample.
  SIGNAL (1)...(18)
MVCSAALGATAVSAQTLSNNSTGTNNGFYYTFWKDSGSATMTLAAGGRYTSQWTNNTNNWVGGKGWNPGNSTRVISYSGNYGVSNSQNSYLALYGWTRSPLIEYYVIESYGSYNPASCSGGTNMGSFQSDGATYDVRRCQRVQQPSIDGTQTFYQYFSVRNPKKGFGQISGTITFANHAAFWASKGMNLGAHNYQVMATEGYQSTGSSDITVSEGPINGGTSSTPPVTTSSSASSVATGGGNTGSGVVVRARGVAGGEHINLRIGGNTVASWNLTTSFQDLSYSGTASGDIQVQYDNDGGSRDVVVDYIRVNGETRQAEDMSYNTALYANGSCGGGGNSELMHCNGVIGFGYTYDCFSGNCSGGSTGGGNTGTSSSAASAGGGNSNCSGYVGITFDDGPTANTPTLVNLLKQNNLTPVTWFNQGNNVVANANYMAQQLSVGEVHNHSYSHPQMGSMTYQQVYDELNRANQAIQTAGAPKPTLFRPPYGTVNSTIQQAAQALGLRVITWDVDSQDWNGATASAIASAANRLTNGQVILMHDGSYTNTNAAIAQIASSLRAKGLCPGRIDPATGRAVAPAGGNTGGGTVSSSTRSSTPVVVSSSRSSSSVAAGGACQCNWWGTRYPICTSTASGWGWENNRSCITTSTCNSQGPGGGGVVCN

SEQ ID NO: 355 - DNA, 1125 bp, Unknown
  Obtained from an environmental sample.
atgaaacgaaccatcttcttaagactcttagccggcgccctcctctccgccgcggccctcgcggccggggggtgccggccctctagtcccccgaaggtcgagatcgaggccaatatcccctccctcaaagaggtctgcgcttcttatttcgagatcggcgcggccgtcgagccgtatcagttatcctctccaccccacgatgcccttctgcggaaacattttaactgcctcgtggcggagaacgtcatgaagcccgcctccatccagccttcggaggggtatttcaactggaccgaagcagacaagatcgtgaactacgccaaagcccacgggatgaagctccgcttccataccctcgtctggcataatcaggtcccggattggttcttcgcgggtaacgacaaaaccctccttttgcagcgcttggagaatcatatccggactatcattaaaagatatggcgataaggtcgactattgggacgtggtaaatgaggctatagacccgagccaaccggatggcatgaggaggagcaaatggtaccagatcaccgggaaggactacatcaagaccgccttccgggtggcagacgacgagctcaggaagaatgggtggaggaaagaaggtcgtcagctctatatcaacgactacaacacccatgatccgacgaagagagagtacatctggcgcttgatcgatgagcttcaaacggaagggattcccgtcgacggagtaggccaccagacgcatatcaatatcgaatggccgcccgtaaaccagatcgtggactcgatccgcttcttcggggaaaaaggcctcgataaccaggtgaccgagctggatgtgagcatatatacggatagatccagttcctacgggagttaccaagcgatcccgcaggaagtcttcatcaagcagggtaatcgctacaaggaactctttgaagggctaaaaagtgtaaaaaactacctcagcaacgtcaccttctggggcatggcggacgatcatacctggctgaaccattggcccatcgaacggcccgatgctcctcttcctttcgatatctatctcaaggccaagccggcgtattgggggatcgtggatgctttgaagctttcgcggtga

SEQ ID NO: 356 - protein, 374 aa, Unknown
  Obtained from an environmental sample.
  SIGNAL (1)...(21)
MKRTIFLRLLAGALLSAAALAAGGCRPSSPPKVEIEANIPSLKEVCASYFEIGAAVEPYQLSSPPHDALLRKHFNCLVAENVMKPASIQPSEGYFNWTEADKIVNYAKAHGMKLRFHTLVWHNQVPDWFFAGNDKTLLLQRLENHIRTIIKRYGDKVDYWDVVNEAIDPSQPDGMRRSKWYQITGKDYIKTAFRVADDELRKNGWRKEGRQLYINDYNTHDPTKREYIWRLIDELQTEGIPVDGVGHQTHINIEWPPVNQIVDSIRFFGEKGLDNQVTELDVSIYTDRSSSYGSYQAIPQEVFIKQGNRYKELFEGLKSVKNYLSNVTFWGMADDHTWLNHWPIERPDAPLPFDIYLKAKPAYWGIVDALKLSR

SEQ ID NO: 357 - DNA, 1155 bp, Unknown
  Obtained from an environmental sample.
atgaataacttcagaaatacatttctaatcgtcgttgtactggcggtcgtcgtcggcgtgctgccggcctgcgaagccggtccgccggaaaatacaagttcgtccctgcaggaggcatatgcagatgtgtttctgatcggcaccgcgctcaatctggcacagatcgacggaagggatgaacaaggcgtacgtctggtggagcggcattttaatgcgattacaccagagaacattacaaaatggggaccgatacatccggcgccgggcgaatataatttcggaccggccgaccggtttgttgaattcggtgaagcccacgacatgttcatgataggccatacgcttgtatggcacagccagacgcccggatgggtattcgaggatgaagccggaaatccgctcggccgcgacgagctcatcgaacgcatgcgcgatcatatccataccgtcgtcggacggtaccggggtagaatacacgcatgggacgtcgtcaacgaagcgttgaatgaagacggaaccctgcgggaatccccctggtaccgtatcatcggcgaggattacctgttgaaagcgttcgagttcgcgcatgaagcggacccggatgccgagctgtactataacgattattctctcgaaaatcccgccaagcgggcgggggcggtacgcctggtccggtacctgcaggagaacggggcgccgatacacgggatcggtacccagggacactactctcttgactggccatcgctcgacgagatcgaaagaaccatcaccgatttcgccgcgttggacgtggacgtcatggttaccgaacttgaaatcgacgtcctcccttccgcgttcgagtatcagggggccgatattgcgatgcgggcggaactcgaagagcggttgaatccgtatcccgacgaactgccggccgaggtcgatgaagcgcttacacagcggtatcgggacatcttcgaggtatttctgcggcacagcgacgttcttacgcgcgtaacgttctggggggtgaccgatggagattcgtggaagaataactggccggtaccgggaaggacgaattatccgctgctgttcgaccgcgaatggcagccaaaaccagcattttattccgtgatcgaagttgcggatgagatgctgaatgaataa

SEQ ID NO: 358 - protein, 384 aa, Unknown
  Obtained from an environmental sample.
  SIGNAL (1)...(25)
MNNFRNTFLIVVVLAVVVGVLPACEAGPPENTSSSLQEAYADVFLIGTALNLAQIDGRDEQGVRLVERHFNAITPENITKWGPIHPAPGEYNFGPADRFVEFGEAHDMFMIGHTLVWHSQTPGWVFEDEAGNPLGRDELIERMRDHIHTVVGRYRGRIHAWDVVNEALNEDGTLRESPWYRIIGEDYLLKAFEFAHEADPDAELYYNDYSLENPAKRAGAVRLVRYLQENGAPIHGIGTQGHYSLDWPSLDEIERTITDFAALDVDVMVTELEIDVLPSAFEYQGADIAMRAELEERLNPYPDELPAEVDEALTQRYRDIFEVFLRHSDVLTRVTFWGVTDGDSWKNNWPVPGRTNYPLLFDREWQPKPAFYSVIEVADEMLNE

SEQ ID NO: 359 - DNA, 2724 bp, Unknown
  Obtained from an environmental sample.
atgacccggtctgtacgaccaagagcatggggggccggcctactggccctcgcgatggtggcgacagtcgcccccacggccaccggccacagccacgacacggcagagcccgtcgtcgtggtctacaccgacttcgagaacgacagcatcgagccgtgggcgcagtccggcggcccgacgctgaacatcgtcgaggtcgacggcgggcacgcgctgcgcgtcggcaaccaccagaacacctgggacggcatccagacccagcccgccaccacgcggatcgagccgggtgtcgagcacaccctgtcgatgcgcgtccggctcgtgggcgacggcacggcgacgacgccggcccggtggatcggccgcgaccccggagccgagaacggctaccagtggatcggtaacacgacgatctcgaccgagagctggacgaccatccggggaacgtggctccctcgggcggacgcgaacgcctcggagctctatgtctaccccgaggtcacaccggtggccggcttcgactacctcctcgatgacctgctcatcgagcgtgctgcccctgtcgacggcggcgccccgggcaccgtcgtctacaccgctggattcgagacggacctggacggctgggaggcacgcgccgacggcgtcggtgtcggccagctcgaccggaccgacgcggagtcggccgagggcgactggtccgcgatcgtgaccgaccgcacctcgcacggccacggcctgcgcctggacgtcacggacatcatggacgcgggcgtcacgtacgagatcagcgcccaggtgaagttcgccgggaccggtggtccgggcaacatctggctgagccaggagctggtcgtggacgggggtagcacctacggcaccgtcctccaggtccctggcgtcacctcgacagcctggacgcagatcaccacgaactacgtcacgccgacggccgaccagctgttcctctacttcgagacgaactggccggacggcatcgaggacgacttcctcctcgacgacgtccgcatccgtgtcgcccctcgggcgatcatccaggaggacctcactccgctgatggacacgctggacgtgcccatgggtgtcgcgatcgaccagcgtgagacctccggcagcctcgcggacctcctgctgctgcacttcgaccaggtcacggccgagaaccacatgaagccggaggcgtggtacgacgcggcgggcaacttccgcatccacccgcaggcccgcgccatcatggacttcgcggcggagaacgacctgcgcgtcttcggtcacgtcctggtgtggcacggccagaccccggacttcttcttcacgcacgcggacggcaccccgctgacctcgagcgaggccgaccaggcgatcctgcgcgaccgcatgcgcacgcacatcttcaacgtcgccgaggccctctccgagtggggcgagtacggcggcgacaacccgctcgtggcctgggacgtcgtcaacgaggtcgtctccgacagcggcgagcacagcgacggcctgcgccgtagccgctggtacgacgtgctgggcgaggagttcatcgacctggcgttcatctacgcgaaccaggcgttcaacggtgagttcgccgctgacgacgccaaccacccggtcacgctcttcatcaacgactacaacaccgagcagtccggcaagcagaaccggtacgccgcgctcatcgaccgcctcatcgagcgcgaggtcccgatcgacgccgtggggcaccagttccacgtcagcctggccatgcccatcgcgaacctgcgcggcgccctcgagcgcttccaggacaccgggctgatccagggcgtcaccgagctcgacgtcaccgtcggcaacaacccgaccgaggcgctgctcgtcgagcagggctactactaccgggacgccttccggctgttccgtgagttcacggaggacctctactcggtcaccgtgtggggtctcaccgacgaccgcagctggcgcagcgctcaggcgccgctgctgttcgacgcgggcctgcaggccaagccggcctactacggcgccatcgacgccgacctggacgcacgcgtgcgtgcggcctacgtgttcgccgaggacatcgccctcgacgaggccgcgctgacgagccccacctgggaccgtctgccgctgcaccagatcgacggggccggcgagttccagctccgctgggcggccgaccacctcacggtgttcgtccacgtcaccgacggtgacgaggtcgagatcgtgctcggcgacgagacctacacggtctcgtcggacggcgagggcgacctggacgcggtcaccgcggccggggagaacggctcctggaccgctgtggtccgcgtgccgctcacggccgagcagggcgacaccgcccagttcgacctccggatcatcgacggcgccaccacctccgggtggaacgtcgaaggtgtcctgggcaccctgaccctggtcgaggagctgtccttcgtcgaggtcgtcgaggcggccgaccggccgaccatcgacggcgagatcgacgccgtgtgggaggacgccaacgtcgtcaccacggacgtccgtatcgagggcgctgctgacggcgcgaaggccgagatccggaccctgtgggacaacaacacgctgttcgtcctcgcggagatcgccgacccggtgatcgacgtgacggcctccagcccgtgggagcaggactcgctc

SEQ ID NO: 360 - protein, 908 aa, Unknown
  Obtained from an environmental sample.
  SIGNAL (1)...(31)
MTRSVRPRAWGAGLLALAMVATVAPTATGHSHDTAEPVVVVYTDFENDSIEPWAQSGGPTLNIVEVDGGHALRVGNHQNTWDGIQTQPATTRIEPGVEHTLSMRVRLVGDGTATTPARWIGRDPGAENGYQWIGNTTISTESWTTIRGTWLPRADANASELYVYPEVTPVAGFDYLLDDLLIERAAPVDGGAPGTVVYTAGFETDLDGWEARADGVGVGQLDRTDAESAEGDWSAIVTDRTSHGHGLRLDVTDIMDAGVTYEISAQVKFAGTGGPGNIWLSQELVVDGGSTYGTVLQVPGVTSTAWTQITTNYVTPTADQLFLYFETNWPDGIEDDFLLDDVRIRVAPRAIIQEDLTPLMDTLDVPMGVAIDQRETSGSLADLLLLHFDQVTAENHMKPEAWYDAAGNFRIHPQARAIMDFAAENDLRVFGHVLVWHGQTPDFFFTHADGTPLTSSEADQAILRDRMRTHIFNVAEALSEWGEYGGDNPLVAWDVVNEVVSDSGEHSDGLRRSRWYDVLGEEFIDLAFIYANQAFNGEFAADDANHPVTLFINDYNTEQSGKQNRYAALIDRLIEREVPIDAVGHQFHVSLAMPIANLRGALERFQDTGLIQGVTELDVTVGNNPTEALLVEQGYYYRDAFRLFREFTEDLYSVTVWGLTDDRSWRSAQAPLLFDAGLQAKPAYYGAIDADLDARVRAAYVFAEDIALDEAALTSPTWDRLPLHQIDGAGEFQLRWAADHLTVFVHVTDGDEVEIVLGDETYTVSSDGEGDLDAVTAAGENGSWTAVVRVPLTAEQGDTAQFDLRIIDGATTSGWNVEGVLGTLTLVEELSFVEVVEAADRPTIDGEIDAVWEDANVVTTDVRIEGAADGAKAEIRTLWDNNTLFVLAEIADPVIDVTASSPWEQDSL

SEQ ID NO: 361 - DNA, 5040 bp, Unknown
  Obtained from an environmental sample.
atggcaagaagtaagcgagtattagcatggattatgtctagtgtgcttctgatatccatggcgatgccatccttcgcatcaggtgattcaagccaagtgccaagggttatatttgaaacaggttttgaaacgggattagatggcttcaaaggacggggtagtgccaccttaactcgaacgactgatgaaacgcaagcaggcgactattcggttcttgtgagcaatcggcttgagcactggaatggggcatcattgccacttacaggcttcgttctaccaggtaatacatatgaatttgttggttacataaaagcaaaagcagatgtagcagacaattatgtcatgagtggtgagtacaatgaggggatttctggaaatcaatatccatggatatctaatcgtttgttaacggttcaagatggctttgttgagtttagaggtgaactaaccatactagaggatatgacgtcctttaatctaaactttgaacatcaaaatgctgaagtggaattttatttagattctgttcaggttattctaatcgaagaaggtcaagtcaatgacttaccaatgaatgtaagaagagcgccacttacacttgctgaaactcccttacatgagatttgggcagatcactttactattggcaatatttatacgccaggttttcgcacagatatacgtggtgaggtattagcccatcattttaatgtgatcacagctgaaaatattatgaagccagatcatttgcaaagggaacaaggtatttttacttttagtgcttccaacgatatgatggaatttgccagagcaaataatcaagaagtcattggacatactttggtgtggcattctcaatccttcccatggtttgaagctttaaatccaacacgtgatgaagctatagccattatgcatgcccatattgaaactgttatgggacattttaatgaaaactacccaggtgtcattacaggatgggatgttttgaatgaagccattcaaccaagacagggtcaagatcctgaaaattggcgcttgcatttaagggataccaaatggttacgtgccattggtgatgattatattgccatcgcttttaacaaagcccatgaaatggatccagatgctattctttattataatgattataatgataatgactattttaaagcaaccattataaaagccatggtgcaggagttgcgtaatgaaggcgtgcccattcatcgtattgggatgcaaggtcattataatttacagacaccattaaactctattagaaccagcgttgagcgttttagtgaaattactggtcatgaagatctaccacctattggcattagtttcacagaaattgatgtaacggtaccagggtttgaaagtgcagcccgtttacctgaagaggtagaaattcgccaagctcagttttatgctcaattaatgcagattttaagagacaacagcgatgtgattcatcgtgttactttctggggtatgtctgatcgtgaatcatggcgtgcagatcgtcatcctaacatgttagatcctcagtatggtccaaagcatgtctttcatgctatagccaatccagaggctttccttacggcctacccattaccagagacgccagatgctcaaacagcctatgcatctcaaggtcaaccagttgtggggcagtttaatttggatgcgtatcaaaattcagaagtaataccagtggctaatcaaatgacagcccataatggcgcaacagcggttgcaagggtggtttggcacgaagatgctatttatattttagccaatgtcagcgatgccacaccgaatgtagcagcttcggctgcccatgagcaagactcacttgaggtatttatttcaaatacggattcaagaatttctaattatatgccaggtgactatcaactgagatttaatcgtgccggcgtgcatacatatggttcgactggttcgattgaaggtatgacctttgcggtacaagatggtccaataggttatcaagttgaagtgcgtattcccttagaaaatgaagtctatgttggcagaagacttggttttgacttacaagtcaatgatgcatgggaagttggcggtacttctggccgacaagcatttgctaaatggaatgatcacactgacaatggctggcagtctacagagttttggggctggttattattacaaggcgatgcggcacctgtcttacccgttgtattagtggaagaaggctttgaaacggatttaggttcattccaaccaaggggtagtagtacactgactcgaacccaagaggttagtcatgaaggcgactattccgtattggttagcaaccgtgtcaacaactggaacggtgcgtcattaccgttaacaggcattgttcaaccaggcaacacttatgagtttgttggttacattagagcaaaagcagatgtaactggatcatatatcatgagtggtgagtttaataatggatctggtgtattagaaaacggtagtattaatcgatggccatggctatcaaaccgttcattaacgatagcagatggttttgttgagtttaagtcagaactaaccatacctagtgacatgacgacgtttaacttgaactttgaacaccaaaatgctgaagtagaattttacttagatgctgttcaagtcactttgattgcagaagctgatgtaacaccagtggacccaccagtagacccaccagtagagccagaaattacagtggtctattcaatggtagatgatgcagccattcaagggattgaagtgggaacaacaggcactgctgaagatttttcggatattagtgaagctttattagtatctggttcaccagttgttactgctgtagcacatccagaagaagcaggaaagatcggtatagagcttagtaatcgagcagagaattggcatgcgctagactttatgttcccagccataggtgtgcagcggggtgggagctatcgatttgtggccagtggccgtatggcagaaggaacaggtaattcaaatcgtagaatgcagtggaatcaaacggatgcgccatggagtgaaatatcaggttctagaaccaatgtggcacctgcagcaaccacatggaccattgacgtgactttaagtcgattacagatcaacacattattaaacgctggtcaaagaggtcttcgaattcaaacgggtaatgcaccaactgtgaccattaccattgacgatgtgtttgtttatcagattggtgacattgacacagcaggtttaccattaccaccacaatggaattttgatttgccaagattatcagaattattcgagccatattttggtcttggtaacatttattcaaccgaaacattaatgaacgctaatgaaacaaaaagagcatttttacatcactttaacgtgattacagcagaaaatggtcataaaccatccagtattgcagggccagaaaatagctttacagtaccagaacctgagcaattcaactttacggatgcagaccgaattgtaaactttgctgttgaaaatgacattgaattagtaggacatgcacttgtatggcattcacaaagtccaaactggctgtttagaagtgcggctaacacaccgctaacaagagcagaagccaaagagcgcatggcatattacatgaaaactgtttcagagcatttcgaagcacaaggtacattaggcgcattttatggttgggatgttgtgaatgaagccatcgccagtggtggtggtacattcgtagatcaaccaggtcattggcgcacgcaaatgcgaacatcatcaccatggttccaagcatttaacaatggattagatgtagaagccggtgaacatgccagtgattatattttctatgcatactattatgcaagaaagtatttcccaacatcgatcctatactacaacgattacaacgatgaaataccaaacaagcgagacaatatcgctcaaatggtagaagagataaatgcactttgggaagcacatgaagaatatgatggtcgcttactgattgaatccatcggtatgcaaagtcattatcacatggaaggttggacaaccagcgtagacaatgtaagagctgctttagatcgatacattgcaacaggtgcaagagtcagtgtgactgagttagatatcacttatggtggtcatggtagtaatgcatatgcatcacttacaccagaacaattagcggcacaagcggagcgatatgcagagatatttacattgtatttagagcgtgcagatcagttaagccgtgtatccatctggggtatgtctgatgctaacagctggagaagttctggattcccattactatttgacagttcacttaatgctaaaccagcatttaatgccattgtagaattagttaaaaactgggagacaccaacagttgtagcaccagtgattcaaacaagaacactagcaccattagaaagtggtgaaagagtctttaccatgttagatgtggtaagaggatctaatgcacctgtatggtttagcataacagacggtgcattaccagaaggtataatccttcattctagaacaggtattttagaaggaacaccagttgaagatggtcactatagctttactgtaactgctagaaattacggcggttcaacaagtcaagcgctgactttaacagtaggtcatccagtagcaccaccagtaacgccaccagtaacgccaccaaccgtaatcattgatgaatcggatataccacaggctggtccaggccttagggcaccacagattgttgtaaccgttcaagaaggcagtgaagtaacgtttgatcttgaaaaattagaagaagttatggcatcactttcaagtcaagtgccattggtgttagatgttgaattggaagattctatcatcaccttggatcaaacattacttaaacgattaacagacaaggcggctggaatcgaaatacaagcagatggatttagttatatgcttccagcagaggtattagaggcaattctttgg

SEQ ID NO: 362 - protein, 1680 aa, Unknown
  Obtained from an environmental sample.
  SIGNAL (1)...(26)
MARSKRVLAWIMSSVLLISMAMPSFASGDSSQVPRVIFETGFETGLDGFKGRGSATLTRTTDETQAGDYSVLVSNRLEHWNGASLPLTGFVLPGNTYEFVGYIKAKADVADNYVMSGEYNEGISGNQYPWISNRLLTVQDGFVEFRGELTILEDMTSFNLNFEHQNAEVEFYLDSVQVILIEEGQVNDLPMNVRRAPLTLAETPLHEIWADHFTIGNIYTPGFRTDIRGEVLAHHFNVITAENIMKPDHLQREQGIFTFSASNDMMEFARANNQEVIGHTLVWHSQSFPWFEALNPTRDEAIAIMHAHIETVMGHFNENYPGVITGWDVLNEAIQPRQGQDPENWRLHLRDTKWLRAIGDDYIAIAFNKAHEMDPDAILYYNDYNDNDYFKATIIKAMVQELRNEGVPIHRIGMQGHYNLQTPLNSIRTSVERFSEITGHEDLPPIGISFTEIDVTVPGFESAARLPEEVEIRQAQFYAQLMQILRDNSDVIHRVTFWGMSDRESWRADRHPNMLDPQYGPKHVFHAIANPEAFLTAYPLPETPDAQTAYASQGQPVVGQFNLDAYQNSEVIPVANQMTAHNGATAVARVVWHEDAIYILANVSDATPNVAASAAHEQDSLEVFISNTDSRISNYMPGDYQLRFNRAGVHTYGSTGSIEGMTFAVQDGPIGYQVEVRIPLENEVYVGRRLGFDLQVNDAWEVGGTSGRQAFAKWNDHTDNGWQSTEFWGWLLLQGDAAPVLPVVLVEEGFETDLGSFQPRGSSTLTRTQEVSHEGDYSVLVSNRVNNWNGASLPLTGIVQPGNTYEFVGYIRAKADVTGSYIMSGEFNNGSGVLENGSINRWPWLSNRSLTIADGFVEFKSELTIPSDMTTFNLNFEHQNAEVEFYLDAVQVTLIAEADVTPVDPPVDPPVEPEITVVYSMVDDAAIQGIEVGTTGTAEDFSDISEALLVSGSPVVTAVAHPEEAGKIGIELSNRAENWHALDFMFPAIGVQRGGSYRFVASGRMAEGTGNSNRRMQWNQTDAPWSEISGSRTNVAPAATTWTIDVTLSRLQINTLLNAGQRGLRIQTGNAPTVTITIDDVFVYQIGDIDTAGLPLPPQWNFDLPRLSELFEPYFGLGNIYSTETLMNANETKRAFLHHFNVITAENGHKPSSIAGPENSFTVPEPEQFNFTDADRIVNFAVENDIELVGHALVWHSQSPNWLFRSAANTPLTRAEAKERMAYYMKTVSEHFEAQGTLGAFYGWDVVNEAIASGGGTFVDQPGHWRTQMRTSSPWFQAFNNGLDVEAGEHASDYIFYAYYYARKYFPTSILYYNDYNDEIPNKRDNIAQMVEEINALWEAHEEYDGRLLIESIGMQSHYHMEGWTTSVDNVRAALDRYIATGARVSVTELDITYGGHGSNAYASLTPEQLAAQAERYAEIFTLYLERADQLSRVSIWGMSDANSWRSSGFPLLFDSSLNAKPAFNAIVELVKNWETPTVVAPVIQTRTLAPLESGERVFTMLDVVRGSNAPVWFSITDGALPEGIILHSRTGILEGTPVEDGHYSFTVTARNYGGSTSQALTLTVGHPVAPPVTPPVTPPTVIIDESDIPQAGPGLRAPQIVVTVQEGSEVTFDLEKLEEVMASLSSQVPLVLDVELEDSIITLDQTLLKRLTDKAAGIEIQADGFSYMLPAEVLEAILW

SEQ ID NO: 363 - DNA, 1317 bp, Unknown
  Obtained from an environmental sample.
gtgaccacccgcgcacaggttcttgatcaggcgctggcactgggccaccggtgtggctgggaaaaactcagcctggacgccatcgccagggcgctgggccgttttggcagcctggctctgtgtgtcgcgctgttgagcgcctgcggcagtagtagtagctccctggatgatccgggtgctggcagcagttcttccagctctgagagcagccaaagctccagcgccagttcccaggctgatggcgacggtacccaggacagcctctacgcccaggcggacttccctgtaggggttgcggtgcaggtggccaattgggagcctttcagcctgtttaccgcgcccgatgccgctgcgcgtcagaacctggttgcccgacacttctccgaagtgaccgcgaccaacgtcatgaaaatgtcctatatgcgcaccaacagtggtggttttaccgacgcgccggcgcgtccgctgattgattttgcccgcgccaatggcatcaaagtgcacggtcacgcactggtctggcatgcggattatcaggtgccaaatgtgtttcgtgactacgaaggggacaattggcaggggcttttaaccgagcatgtcgagggcgttatggggctgtttgacgacaccgtggtaagttgggatgtcgtaaacgaagcggttgataccggctcacctgacggctggcgccggtcgattttctataattttgcgccgccggaagcagggcaggtgccggaatatattgaagtggcttaccaggccgctcgagaggccaatccggaagtgaccctctactacaacgattttgacaacacggccaataccgggcgcctcaacaagaccctggaaattgccgatcgcctgaaagagctggacgcgatcgacggtatcgggttccagatgcacgcctatatgaactacccgagtattgcgcagtttcgcaatgcctttcaggaagtggtcgatcgtgacctgaaagtcaaagtcaccgagctggacattgccatcgtcaacccttacggcagctcgacgcctccgccgctgccggagtttgatcaggcgctggccgacgcccaaggtgtccgttactgccagattgccgaggcctatctggatgtcgttcctgccgagctgcggggtggtttcaccgtctggggcctgaccgatgacgacagctggctgatgggagcgttcgcgtccgcaaccggcgcccaatacgaccaggtctatccggtgttgtttgacgataatctgcaagccaagcccgcgttctttggcgtcaagcgcgccctccgcggcgaaccctgcgagtaa

SEQ ID NO: 364 - protein, 438 aa, Unknown
  Obtained from an environmental sample.
MTTRAQVLDQALALGHRCGWEKLSLDAIARALGRFGSLALCVALLSACGSSSSSLDDPGAGSSSSSSESSQSSSASSQADGDGTQDSLYAQADFPVGVAVQVANWEPFSLFTAPDAAARQNLVARHFSEVTATNVMKMSYMRTNSGGFTDAPARPLIDFARANGIKVHGHALVWHADYQVPNVFRDYEGDNWQGLLTEHVEGVMGLFDDTVVSWDVVNEAVDTGSPDGWRRSIFYNFAPPEAGQVPEYIEVAYQAAREANPEVTLYYNDFDNTANTGRLNKTLEIADRLKELDAIDGIGFQMHAYMNYPSIAQFRNAFQEVVDRDLKVKVTELDIAIVNPYGSSTPPPLPEFDQALADAQGVRYCQIAEAYLDVVPAELRGGFTVWGLTDDDSWLMGAFASATGAQYDQVYPVLFDDNLQAKPAFFGVKRALRGEPCE

SEQ ID NO: 365 - DNA, 3246 bp, Unknown
  Obtained from an environmental sample.
atgaaccacttcgcttcaaaatcgctgcgcatggcgtggcaacccggactgcttgcgacaaccgtgctgccgttggcggctgccgccccaataccagcgccgaatacggataccaaagtgagcaatacttcgtccatcaccactccggctgcggctccacagtcgcagccacaaccaacgcaagacgcaaacgctcccgcaccgcttaaagcggctttccgggataagtttctcatcggcgcggtgctgagtgacgctgcgctgcgaggcagtgcgcccgacaaggtggcgatagccaccacgcactttaacgcgctcaccgccgaaaacgccatgaagccagacgcgatgcaaccgcgcgaagggcagttcaacttcgctgcaggcgatcggctcgtcgaactcgccgaaaaaagcggcggtgtgcccatcggccacacgctggtgtggcacgcgcaaacaccgaagtggttttttgaagggccggatggacagcccgcgacgcgcgaactggctttggagcgcatgcgcaaacacatttccactgtggtggggcgctacaaagggcgcatcaaggagtgggatgtggtgaacgaagccatcaacgacggacccggtgtgctgcgtccctctccctggctcaaagccatcggcgaagattacatcgccgaagccttccgcgccgcgcacgccgccgaccccgacgcgattttgatttataacgattacaacatcgaactgggctacaaacggcccaaagcgctgcaactcctaaaatcgctcattgaccagaaagtgccgattcacgccgtgggcattcagggtcactggcgcatggacaacccgaacttcgccgaagtggaacaggccatcaaagagttttcggcgctggggttgaaagtcatgatcaccgaactcgacatcggcgtgctgccgacgcgttatcagggcgcggatatttcagcgaccgaaaccatgacgcccgaacagcgcgccgtgatgaacccctatacggacggattgccggacgatgtggcgcaaaagcacgccgagcgctatcgccaggcgtttgagatgttcctgcggcacaaagacaaaatcagtcgtgtgacattttggggtgtggacgacggcacttcgtggctgaacggtttcccggtgcgcggccgcaccgattatccgctgctatttgatcgtcagggcaagccaaaacccgcctttttcgcggtgcaaaacgcggcgatgggcgcaacagcgcaaccgagcgccagcgctcccgcaacgcatggcgccgctcctgcatccaccaacattcgcggcgccgagtttcctcgcgtggaaagcgacgggcgggtgacgtttcgcatcaaagcgcctgacgcgcaaaaagtgcaatttgatttaggtaagccttacgacgccacccgcgacgccgagggcaactggacggcgaccacagagccacaagtgcccggcttccattattattttttgattgtcgatggagtgcgcgtggccgacccggcgagcgaaaccttttacggtgcgggccgccagatgagcggcatcgaaattcccgatcccgacagcgcgttttattcgccgcaaaacgtgccgcatggcgaagtgcgcgaacgctggtatttttccaacaccacgcaggcgtggcggcgcatcttcatttatacgccgccgggttacgacaccgatcaggccatgcgttttcctgtgctgtatttgcagcacggcggtggcgaagacgaacgcggctggcccaatcaggggcgcgtgagctttatcatggacaatctcatcgcgcagggcaaagccaaaccgatgctggtggtgatggagcaaggctatgcgcgcaagcccgatgaaccgcaggtgccgctgcgcccgcccggaagcaacgccggagcgatgccgcccgactttaatcgcatgttcgccacgctgggcgaagtgttcaccaaagacctgattccgtttattgacgcaaattaccgcaccaaaaccgagcgcgaaaaccgcgcgatggccggactttcgatgggtggaatgcaaagtttcatcatcggcctggcgaacaccgatctattcgcgcacctcggcggtttcagcggcgcgggtggtggttttggcggcggcgccttcgacgccaaaaccgcgcacggcggtgtgatggccgatgccgatgccttcaacaaaaaagttcgcacgatgtttctcagcatcggcactgccgagaacgagcgttttcagagcagcgtgcgcggttaccgcgacgcgctgaccaaagcgggcatcaaaaccacgttctacgaatcgcccggcacttcgcacgagtggctgacatggcgccgcagcctgcgcgaattcgcgccgctcttgtttcaagaggccaacacgcagatcgagcgcggccccaatgcccgcccgattgcgccgcagccgattgttcttggcccgggcgacaagcccgccttccctccggcgccctccggtttcgatgcgcggcgcgatggcattccgcacggcgaaattaaacttgtggaatacccttctgccacggtcggcaccacgcgcaagatgcaggtctatacgccgccgggctacaacccgcaagaagaatatcccgtgctctatttgctgcacggcatcggcggcgacgagtgggaatggaaaaatggcggcacgcccgaagtgattctcgacaacctctacgctgagaagaaactccagccgatgatcgtggtgatgcccaatgggcgcgcgcaaaaagacgaccgtcctatcggcaacgtgttcgcttccgctccggcgtttgcgacgtttgagaaagatttgctgaacgacattatcccctttgttgagaagaattacccgaccaaaaccggcccgcaaaatcgcgctttggccggtctttcgatgggcggcgggcaatctctcaactttggcctcggcaacctcgacaccttcgcgtgggttggcggcttttcgtccgcgcccaacacgcgcagcggcgcaagtctactggccaatcccgacgacgccaaaaagaagctgaagctgctgtgggtttcgtgcggcgataaagacaatttgatgtttatcagccagcgcacgcaccgttatcttgccgagaataacgtgccgcacatctggcatgtacagcccggcggacacgacttcaaggtgtggaagcaagacctgtataacttcgcccaactgctattccgttaa

SEQ ID NO: 366 - protein, 1081 aa, Unknown
  Obtained from an environmental sample.
  SIGNAL (1)...(65)
MNHFASKSLRMAWQPGLLATTVLPLAAAAPIPAPNTDTKVSNTSSITTPAAAPQSQPQPTQDANAPAPLKAAFRDKFLIGAVLSDAALRGSAPDKVAIATTHFNALTAENAMKPDAMQPREGQFNFAAGDRLVELAEKSGGVPIGHTLVWHAQTPKWFFEGPDGQPATRELALERMRKHISTVVGRYKGRIKEWDVVNEAINDGPGVLRPSPWLKAIGEDYIAEAFRAAHAADPDAILIYNDYNIELGYKRPKALQLLKSLIDQKVPIHAVGIQGHWRMDNPNFAEVEQAIKEFSALGLKVMITELDIGVLPTRYQGADISATETMTPEQRAVMNPYTDGLPDDVAQKHAERYRQAFEMFLRHKDKISRVTFWGVDDGTSWLNGFPVRGRTDYPLLFDRQGKPKPAFFAVQNAAMGATAQPSASAPATHGAAPASTNIRGAEFPRVESDGRVTFRIKAPDAQKVQFDLGKPYDATRDAEGNWTATTEPQVPGFHYYFLIVDGVRVADPASETFYGAGRQMSGIEIPDPDSAFYSPQNVPHGEVRERWYFSNTTQAWRRIFIYTPPGYDTDQAMRFPVLYLQHGGGEDERGWPNQGRVSFIMDNLIAQGKAKPMLVVMEQGYARKPDEPQVPLRPPGSNAGAMPPDFNRMFATLGEVFTKDLIPFIDANYRTKTERENRAMAGLSMGGMQSFIIGLANTDLFAHLGGFSGAGGGFGGGAFDAKTAHGGVMADADAFNKKVRTMFLSIGTAENERFQSSVRGYRDALTKAGIKTTFYESPGTSHEWLTWRRSLREFAPLLFQEANTQIERGPNARPIAPQPIVLGPGDKPAFPPAPSGFDARRDGIPHGEIKLVEYPSATVGTTRKMQVYTPPGYNPQEEYPVLYLLHGIGGDEWEWKNGGTPEVILDNLYAEKKLQPMIVVMPNGRAQKDDRPIGNVFASAPAFATFEKDLLNDIIPFVEKNYPTKTGPQNRALAGLSMGGGQSLNFGLGNLDTFAWVGGFSSAPNTRSGASLLANPDDAKKKLKLLWVSCGDKDNLMFISQRTHRYLAENNVPHIWHVQPGGHDFKVWKQDLYNFAQLLFR

SEQ ID NO: 367 - DNA, 1338 bp, Unknown
  Obtained from an environmental sample.
atgaaaagaattggattactatttatggcgttggcgctaaccgcatttatggcgcagcattcgtccgctcaaaggatttgcaataaccaaacagggacccatggtggattctactacacatggtggagtgatgggggtggatctgcatgtataacaatgggcgatggcggtaactacagcacccaatggagcaataccggtaactttgtaggcggtaagggttggagcacaggaagatccaaccgcgtaattagttacaatgctggtaactggtcgccatcgggtaatgcttacctatgtttatatggctggactaccaacccgcttgttgagtactacgtagttgatagctggggttcttggagacctcccggagcaacatcgcagggaacagtaaatactgatggtggcacctatgagatatacagaactcagcgtgtaaaccagccatctattcaggggaatactactttctatcagtattggagcgttagaacctctaaaagggccactggaagcaatgctaccatcaccttccagaaccacgtaaatgcttgggcaagtaggggttggaacttgggagctcatagctatcaggtactggctaccgagggttatcagagcagcggaagttcaaatattactgtttgggaaggtggttcaagtggaggttcttcaggtggaagcaccggaggcagcactggaggtggatcacacgagatcattgtaagagcccgtggtgtagtaggttcagagcaaattaggcttagggttggcaatacaaccgttgcaacttggacccttactaccggttatagggactatagggctactacctcagctactggtggtattctggtagagtacttcaatgatagcggcaaccgtgatgttcagattgattacattagggtaaacggctcaactcgtcaatctgagaacatgtcgtacaatacaggggtatggcagaatggctcatgcggcggctccaatagcgagtggctacactgcaacggagctattggctacggcgatgtggttactggcagatcaaccgctgttgaggaagcatttactgctgccgaggattgtggctgtgaacctaaggcaaccctattccccaaccctgctggcagtaccctcagtattatgctagacaggcaaccctatggcgatgtaagtattagaatatataatacggtaggtgcagttgttcgcaccatcaacaatccagacctactcactgaggttgatgtcagtgcattaaattctggaatctactttgtagagcttaggtccgaaggacatgtaagcaactacaaatttattaaaaagtag

SEQ ID NO: 368 - protein, 445 aa, Unknown
  Obtained from an environmental sample.
  SIGNAL (1)...(23)
MKRIGLLFMALALTAFMAQHSSAQRICNNQTGTHGGFYYTWWSDGGGSACITMGDGGNYSTQWSNTGNFVGGKGWSTGRSNRVISYNAGNWSPSGNAYLCLYGWTTNPLVEYYVVDSWGSWRPPGATSQGTVNTDGGTYEIYRTQRVNQPSIQGNTTFYQYWSVRTSKRATGSNATITFQNHVNAWASRGWNLGAHSYQVLATEGYQSSGSSNITVWEGGSSGGSSGGSTGGSTGGGSHEIIVRARGVVGSEQIRLRVGNTTVATWTLTTGYRDYRATTSATGGILVEYFNDSGNRDVQIDYIRVNGSTRQSENMSYNTGVWQNGSCGGSNSEWLHCNGAIGYGDVVTGRSTAVEEAFTAAEDCGCEPKATLFPNPAGSTLSIMLDRQPYGDVSIRIYNTVGAVVRTINNPDLLTEVDVSALNSGIYFVELRSEGHVSNYKFIKK

SEQ ID NO: 369 - DNA, 1077 bp, Unknown
  Obtained from an environmental sample.
atgaaatcatttatcactggcaaaaaaattgctgctggactaattactgcagctgctttgagcgcatctatggtgagcgcgcaaaccctgacttcaaattctcaaggcacccacgacggatttttctactctttctggaaggactcaggcaacgcctcaatgaacttattggcgggcggccgttatcagtctagctggaacaccggcaccaacaactgggtaggcggtaaaggctggaacccaggcactaacaaccgtgtaattaactactctggttactacggtgtggacaactcccaaaactcttacgtcgcgctttacggctggaccagaaacccattggttgagtactacgtgattgagagctacggctcatacaaccctgctagctgctctggcggcaccgatttcggtagcttccaaagtgacggcgccacctacaacgtgcgtcgttgccagcgcgtgcaacagccttcgatcgatggcacccagactttctaccaatacttcagcgtgagaaatccgaaaaaagggtttgggaacatttctggcaccatcacctttgctaaccacgtaaactactggagaagcagagggatgaatcttggtaaccacgattaccaagttctcgctactgaaggctacagaagcacgggttcttctgacctcaccatcagccaaggcgcaagcaacaacggcggtggcggcagtagctcaagtgctccatctgctgggggcggtagcaagacaatcgtcgtgcgggcacgcgggactaccggacaagagcaaatccgtttgcgggtgaacaacactattgttcagacctggaccttgtccaccaccatgcgcgactacaccgtcaacactaacttggcaggcgggtcattggttgaatacttcaatgacagcggcaaccgcgacgtccaagttgattacatcagcgtaaatggcaatgttcgccaatccgaaaaccaaacctacaacaccggtgtctaccagaacggtgcgtgtggcggcggtaacggccggagcgagtggctccattgcaacggtgcaatcgggtacggcgatatctaa

SEQ ID NO: 370 - protein, 358 aa, Unknown
  Obtained from an environmental sample.
  SIGNAL (1)...(27)
MKSFITGKKIAAGLITAAALSASMVSAQTLTSNSQGTHDGFFYSFWKDSGNASMNLLAGGRYQSSWNTGTNNWVGGKGWNPGTNNRVINYSGYYGVDNSQNSYVALYGWTRNPLVEYYVIESYGSYNPASCSGGTDFGSFQSDGATYNVRRCQRVQQPSIDGTQTFYQYFSVRNPKKGFGNISGTITFANHVNYWRSRGMNLGNHDYQVLATEGYRSTGSSDLTISQGASNNGGGGSSSSAPSAGGGSKTIVVRARGTTGQEQIRLRVNNTIVQTWTLSTTMRDYTVNTNLAGGSLVEYFNDSGNRDVQVDYISVNGNVRQSENQTYNTGVYQNGACGGGNGRSEWLHCNGAIGYGDI

SEQ ID NO: 371 - DNA, 1245 bp, Unknown
  Obtained from an environmental sample.
gtgaccgggatcgcgagaaaaggcgtatggtccgtgatttccggaactttcactgccggggattacgattcctacctgctgtatgtcgaaacacaggaccagggcggcggacacccgacgctgagctttgaaatccggaacttcagactgacggcaccggaaggcatcgctccgccgaaggcgacagaagaaccggctgacgcggcagaggcgacgcctgttccggcactgagcgagattccgggcctgaaggacgtctacgcggactactttgacttcggcgctgcggcgccgcagtatgcattcggcctcggccagacccagctgcaggacctgatgatcagccagttcagcatcctgacccctgaaaacgaactgaaaccggacagcgtgcttgatgtccagacgagtaaaaaactggcggcagaagacgaaaccgcggtggcgatcaggctgaacgccgcaacgccgctgctgaagttcgcgcagaagaacggcatcaaagtgcacggccatgtgctggtatggcacagccagacgccggaagctttcttccatgaaggatacgataccaagaaaccctatgtgacgagagaggttatgctcggccgcctggaaaactatatccgtgaagtgctgacgcagacagaggaacagttcccgggcgtgatcgtcagctgggacgtcgtgaacgaggcgatcgacgacggtactcactggctgcggaagacttccagctggtacaaagtcgtcggcgaggatttcctgaacagggcttttgaatacgccaggaaatacgccgcggagggcgtgctgctgtactacaacgattacagcacggcaaattcggctaaactgatgggcatcacgaagctgctgaagcagctgattccagacgggaatatcgacggctacggattccagatgcaccatgacctcggctggccgagcatcgaccttatggcggcagctgtgaagcagattgccggcctggggctgaaactgcgcgtcagcgaactggatatcggcgtatccaagaacaatcaggaaaactatgacaaacaggccaaacgctacaaggaaatgctgaacctgatgctgcagtacgcggaccagacggaagccgtgcaggtctggggcctgacggacaacatgagctggagaaccggcaaatacccgctgctgttcgacagcgcggcaaaaccgaaaaaggcgttcttcgcggtgattgaagccgcagaggaa

SEQ ID NO: 372 - protein, 415 aa, Unknown
  Obtained from an environmental sample.
MTGIARKGVWSVISGTFTAGDYDSYLLYVETQDQGGGHPTLSFEIRNFRLTAPEGIAPPKATEEPADAAEATPVPALSEIPGLKDVYADYFDFGAAAPQYAFGLGQTQLQDLMISQFSILTPENELKPDSVLDVQTSKKLAAEDETAVAIRLNAATPLLKFAQKNGIKVHGHVLVWHSQTPEAFFHEGYDTKKPYVTREVMLGRLENYIREVLTQTEEQFPGVIVSWDVVNEAIDDGTHWLRKTSSWYKVVGEDFLNRAFEYARKYAAEGVLLYYNDYSTANSAKLMGITKLLKQLIPDGNIDGYGFQMHHDLGWPSIDLMAAAVKQIAGLGLKLRVSELDIGVSKNNQENYDKQAKRYKEMLNLMLQYADQTEAVQVWGLTDNMSWRTGKYPLLFDSAAKPKKAFFAVIEAAEE

SEQ ID NO: 373 - DNA, 1539 bp, Unknown
  Obtained from an environmental sample.
ttgattggctgcgtcatgtcgccgccggaagcgggaagtccccgttttgatcttttaacccggcactttaatgtcatcaccgcggaaaacgccatgaagcccgcgtcgttgcagcgcgaaaagggggtgtttacttttgaacaggcggacatgatggtggacgcggtattggagcggggactgaagatccacggacatactctggcctggcaccagcagtctccggagtggatgaatcatgaggggatttcccgggacgaagccgtggaaaatctcaccgtccacgccaaaaccgcggccgctcattttagggggcgggtcatatcctgggatgtactcaacgaggcgatcattgacaatccccccaaccccggggattggcgggcatccctcaggcaaagcccctggtacaaagccataggcccggattacgtggagcttgtgttcaaggcggccagggaggcggacccggaggcaaaactttattataacgattacaaccttgataaccggaacaaggccctggcggtttacaacatggtcagggaactgaacgaaaagaatccgaatccgggcggcaggcccctcatcgacggcgtgggcatgcagggccattaccgcctgaataccaataccgataacgtgaggctgtcgctggaacggtttatttccctgggggtcgaggtcagcatcacggagctcgatatacaggccggttcggattcaaaccagacagagcggcagcgggtggaacagggcctggtctatgccgctttgtttaccattttccgggaacacgcggcaaacataggccgggtaactttttggggacttgacgacggggcaagctggcgttccgcggcgagtccctgcctctttgataaaaacctcaacgcaaaacctgccttttacgcggtcctggacccggattcctttattgcggaaaacagcgccctgctgatcagggaagcgaaagagggagaggcttattatggtacgcctgctttaggcgccgtccctgatcccctctgggacagggcgccttccctcccggtggatcagtacctcatggcctggcagggcgcttcgggaagggcaaaagtcctctgggacgaaaaaaatctctatgtgctggtccgggttgaaaacgcggaaataaacaaggacagttccaacagctacgaacaggattcggtcgaaatttttattgatgaggataaccggaaaagttcctttttcagggaggatgacgggcagtaccgggtcaattttgccaacgaggcgggctttaacccctcgtccgccggggcggggtttgtttcggccgccgcggtggatggaaaatcctataccgttaccatgaagattccctttaaaacaatagtccccggagcggggacgcgtatcgggtttgatgtccagatcaacggcgcgtcggccagggggatacgggagagcgtggcggtatggaatgataccacgggcaattcatttcaggatacctcaggttacggggtactgcggttagtaaaaaagtaa

SEQ ID NO: 374 - protein, 512 aa, Unknown
  Obtained from an environmental sample.
MIGCVMSPPEAGSPRFDLLTRHFNVITAENAMKPASLQREKGVFTFEQADMMVDAVLERGLKIHGHTLAWHQQSPEWMNHEGISRDEAVENLTVHAKTAAAHFRGRVISWDVLNEAIIDNPPNPGDWRASLRQSPWYKAIGPDYVELVFKAAREADPEAKLYYNDYNLDNRNKALAVYNMVRELNEKNPNPGGRPLIDGVGMQGHYRLNTNTDNVRLSLERFISLGVEVSITELDIQAGSDSNQTERQRVEQGLVYAALFTIFREHAANIGRVTFWGLDDGASWRSAASPCLFDKNLNAKPAFYAVLDPDSFIAENSALLIREAKEGEAYYGTPALGAVPDPLWDRAPSLPVDQYLMAWQGASGRAKVLWDEKNLYVLVRVENAEINKDSSNSYEQDSVEIFIDEDNRKSSFFREDDGQYRVNFANEAGFNPSSAGAGFVSAAAVDGKSYTVTMKIPFKTIVPGAGTRIGFDVQINGASARGIRESVAVWNDTTGNSFQDTSGYGVLRLVKK

SEQ ID NO: 375 - DNA, 570 bp, Artificial Sequence
  Synthetically generated polynucleotide
atggcccttatggcttcgacattctactggcacttgtggactgatggtatagggacagtaaatgctaccaatggatctgatggcaattacagcgtttcatggtcaaattgcgggaattttgttgttggtaaaggctggactaccggatcagcaactagggtaataaactataatgcccacgccttttcggtagtgggtaatgcttatttggctctttatgggtggacgagaaattcactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 376 - protein, 189 aa, Artificial Sequence
  Synthetically generated polypeptide
MALMASTFYWHLWTDGIGTVNATNGSDGNYSVSWSNCGNFVVGKGWTTGSATRVINYNAHAFSVVGNAYLALYGWTRNSLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 377 - DNA, 570 bp, Artificial Sequence
  Synthetically generated polynucleotide
atggcccttatggcttcgacattctactggcacttgtggactgatggtatagggacagtaaatgctaccaatggatctgatggcaattacagcgtttcatggtcaaattgcgggaattttgttgttggtaaaggctggactaccggatcagcaactagggtaataaactataatgcccacgccttttcggtagtgggtaatgcttatttggctctttatgggtggacgagaaatccactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 378 - protein, 189 aa, Artificial Sequence
  Synthetically generated polypeptide
MALMASTFYWHLWTDGIGTVNATNGSDGNYSVSWSNCGNFVVGKGWTTGSATRVINYNAHAFSVVGNAYLALYGWTRNPLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 379 - DNA, 570 bp, Artificial Sequence
  Synthetically generated polynucleotide.
atggcccttatggcttcgacattctactggcacaattggactgatggtatagggacagtaaatgctaccaatggatctgatggcaattacagcgtttcatggtcaaattgcgggaattttgttgttggtaaaggctggactaccggatcagcaactagggtaataaactataatgcccacgccttttcgccggtgggtaatgcttatttggctctttatgggtggacgagaaattcactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 380 - protein, 189 aa, Artificial Sequence
  Synthetically generated polypeptide.
MALMASTFYWHNWTDGIGTVNATNGSDGNYSVSWSNCGNFVVGKGWTTGSATRVINYNAHAFSPVGNAYLALYGWTRNSLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 381 - DNA, 594 bp, Artificial Sequence
  Synthetically generated
atggcccagacctgcctcacgtcgagtcaaaccggcactaacaatggcttctattattccttctggaaggacagtccgggcacggtgaatttttgcctgcagtccggcggccgttacacatcgaactggagcggcatcaacaactgggtgggcggcaagggatggcagaccggttcacgccggaacatcacgtactcgggcagcttcaattcaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagtgaaggcggttga

SEQ ID NO: 382 - protein, 197 aa, Artificial Sequence
  Synthetically generated
MAQTCLTSSQTGTNNGFYYSFWKDSPGTVNFCLQSGGRYTSNWSGINNWVGGKGWQTGSRRNITYSGSFNSPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSEGG

SEQ ID NO: 383 - DNA, 585 bp, Artificial Sequence
  Synthetically generated
atggcccagacctgcctcacgtcgagtcaaaccggcactaacaatggcttctattattccttctggaaggacagtccgggcacggtgaatttttgcctgcagtccggcggccgttacacatcgaactggagcggcatcaacaactgggtgggcggcaagggatggcagaccggttcacgccggaacatcacgtactcgggcagcttcaattcaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagttga

SEQ ID NO: 384 - protein, 194 aa, Artificial Sequence
  Synthetically generated
MAQTCLTSSQTGTNNGFYYSFWKDSPGTVNFCLQSGGRYTSNWSGINNWVGGKGWQTGSRRNITYSGSFNSPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVS

SEQ ID NO: 385 - DNA, 1122 bp, Unknown
  Obtained from environmental sample
gctgacctgcggcgacgtcgcctgctgcaggcggccgccacgctgccgctgcttggctggtgcagtgcgcaggccgcgcccgcaccgcgctggccggcgtggcaggtactgctcgacagcagcctgagccgcgacggacgcatgatcgatcgcagccaggacgatcagcgcagcacctccgaaggccagtcctatgcgttgttcttcgccctggtcgacaacgaccaggcgctgttcgaccgcatcctgggctggacccaggacaacctcgccggtggcgacatgcgccagcacctgcccgcctggttgtgggggcgggatgacaagggaagctggcgggtactggacgacaacccggcctcggactccgatctctggctggcctatgcgctgctggaaggcgcgaggctgtggcgccgtcccgcgttgaaggccatcgccgagggcctgctcgcgcaggtgcgggcacgcgagatcgtggacctgcccgggctcggcccgatgctgttgccgggcccacagggattcaccgaaggggacgcgacgcgggtcaaccccagctatctgccactgccgctgctgcgccgctttgcggtggaggatcgcagcgggccgtggcaggcgctggcgcgtaacagcgtgcagctgttgcagcagaccagcccaaaggggttcgcaccggactgggcggcgtggaaaggcgatcgtttcgtcgtcgatccggtgcgcggcgcggtcggcagctacgatgcgatccgctgctacacctgggcaggcatgaccgcgccgcgcgatgcgttgttccgcacgcagctggcggccctgtccgggccgctgcagcgcctgcgcagtggtgcgccgatgtgggaaaaaatcgacacccgcagtggccaggggcagggcgaaggcaactacggattccgcgcggcactgctgccgtatctgatcgcgcagggcgacgcggagcgcgcgcagtcgctgcgggccagcctgcccagcgccgaacagcagcgtgctgatgcaccggcctactactcgcagatgctggccctgttcggcctgggctgggccgaagggcgctggcgtttcgccgccgacggccgcctgcagccgcgctggtag

SEQ ID NO: 386 - protein, 373 aa, Unknown
  Obtained from environmental sample
  SIGNAL (1)...(25)
  DOMAIN (5)...(359): Glycosyl hydrolases family 8
ADLRRRRLLQAAATLPLLGWCSAQAAPAPRWPAWQVLLDSSLSRDGRMIDRSQDDQRSTSEGQSYALFFALVDNDQALFDRILGWTQDNLAGGDMRQHLPAWLWGRDDKGSWRVLDDNPASDSDLWLAYALLEGARLWRRPALKAIAEGLLAQVRAREIVDLPGLGPMLLPGPQGFTEGDATRVNPSYLPLPLLRRFAVEDRSGPWQALARNSVQLLQQTSPKGFAPDWAAWKGDRFVVDPVRGAVGSYDAIRCYTWAGMTAPRDALFRTQLAALSGPLQRLRSGAPMWEKIDTRSGQGQGEGNYGFRAALLPYLIAQGDAERAQSLRASLPSAEQQRADAPAYYSQMLALFGLGWAEGRWRFAADGRLQPRW

SEQ ID NO: 387 - DNA, 1221 bp, Unknown
  Obtained from environmental sample
atgctaaaagttttacgcaaaccggttttatcaggtttatctttagccttattattacctgttggaataactagtgttggtgcctcagatacagaatcctatgcaaaaaaaccaatgattagtgctttaacagcaccacagcttgaccaacgatataaagattccttcaccattggtgcagctgttgaaccttcaatgttacaaggaaaagacgcacaaatgttaaaacgccattttaacagcatcgtagcagagaatgttatgaagcctggaagtttgcagccagtagaagggcaatttaactgggggccttctgacgaaatcattaaatttgccaaagaaaatggcatggacgtacgcggccataacctagtttggcatagtcaggtaccggcatggttcttcttggataaaaatggaataaaaatgaccttagagactgatccagttaaacgcgaggaaaacaaacagctcttattacagcgtttgcgtgaccatattaaagcagtcgtaacacgctataaagatgatattaaatcttgggatgtagtaaatgaagtaatctcagatggtggtggattacggcaatccgattggtacagaataacaggtactgactatattaaagtcgcttttgagaccgccagacaatatgccgcaccagacacaaaactttatattaatgattacaatacagaagtagaacctaagagaactagcctttataacctagttaagagcttgaaggaagagggagttccaattgatggtgttggccaccagtctcacatccaaatcggctggccttctgataaagatattgaagatactattaacatgtttgccgatcttggtttagataaccaaatcacggagcttgatgttagtatgtatggttacccgccaagggcgtatccaacttatgctgccattccggaatttaaatttatggatcaagcagaccgttatgaccgtttatttaagttgtatgagaaattgggcgataaaattagcaatgtgacattctggggcattgccgataaccatacttggctcaatgaccgtgcagatgtatactatgatgcaaatggtaacgttgtaactgatccaactgcaccatttgcaaaaattgaaagaagagcaggaaaagatgcaccattcgtgtttgatccggattacaatttaaagccagcctactgggccattatcgaccataaataa

SEQ ID NO: 388 - protein, 406 aa, Unknown
  Obtained from environmental sample
  SIGNAL (1)...(28)
  DOMAIN (47)...(406): Glycosyl hydrolase family 10
  SITE (289)...(299): Glycosyl hydrolases family 10 active site. Prosite id = PS00591
  SITE (344)...(347): N-glycosylation site. Prosite id = PS00001
  SITE (353)...(356): N-glycosylation site. Prosite id = PS00001
MLKVLRKPVLSGLSLALLLPVGITSVGASDTESYAKKPMISALTAPQLDQRYKDSFTIGAAVEPSMLQGKDAQMLKRHFNSIVAENVMKPGSLQPVEGQFNWGPSDEIIKFAKENGMDVRGHNLVWHSQVPAWFFLDKNGIKMTLETDPVKREENKQLLLQRLRDHIKAVVTRYKDDIKSWDVVNEVISDGGGLRQSDWYRITGTDYIKVAFETARQYAAPDTKLYINDYNTEVEPKRTSLYNLVKSLKEEGVPIDGVGHQSHIQIGWPSDKDIEDTINMFADLGLDNQITELDVSMYGYPPRAYPTYAAIPEFKFMDQADRYDRLFKLYEKLGDKISNVTFWGIADNHTWLNDRADVYYDANGNVVTDPTAPFAKIERRAGKDAPFVFDPDYNLKPAYWAIIDHK

SEQ ID NO: 389 - DNA, 1008 bp, Unknown
  Obtained from environmental sample
atgagtgttaagccgttctggcgtcaatggatactctgtttcatggtgatgttttttagcgcccaggcggccgcagatggctggagtacctttaaaagtcgctttatgagcagcgatggtcgtatcagcgatacggccaacaacaacgtcagccataccgaaggtcagggttacggcatgttactggcggtggcgaatgacgatcgccccacctttgataagctgtggcaatggacgcagacccatctgcgcaatccgcaaaatgatctgttttactggcgctacactcccggtgcgaccgatcccgtcgccgataaaaataatgcgtcggatggtgatgtcctgattgcctgggcgttacaacgtggggcacagaagtggtccgccagcagctaccaacaggcgtcagatcgtatccagcgtgcgattgtgaagcacaacgtgatcacctatgccgggcataccgtgatgctgccgggcgtgcagggcttcaataaaaccagttttatcgtgctcaatccgtcctattttctgttccccgcctggcgtgagtttgcgcagcacagccatttgcgcgtctggaatcagctgattgatgatggcatggacctgctgggcgatatgcatttcggcaaaagtggcttgccgcttgattgggtagcgctgaatgccgacggttcggtggcacctgcggtcgggtattccaatcgttttagctatgacgcgattcgtattccactgaatatctggtggtacgacccgcaaagcctgcgcctggtgccgtaccagcgtgtctggcagggctatggacgcttaaccaccccggcgtggtttgatgtgctggcgaatacgcctgcaccttataacctcgacggcgggctgctggcgatccgagatttgacgctgagcgagacggggtatctcagtgaccggttggcaccggatcagaactacttctcggcgagtttgcagttgctgacctggatggcatatcaggaaaggcgctga

SEQ ID NO: 390 - protein, 335 aa, Unknown
  Obtained from environmental sample
  SIGNAL (1)...(25)
  DOMAIN (2)...(333): Glycosyl hydrolases family 8
  SITE (49)...(52): N-glycosylation site. Prosite id = PS00001
  SITE (109)...(112): N-glycosylation site. Prosite id = PS00001
  SITE (167)...(170): N-glycosylation site. Prosite id = PS00001
MSVKPFWRQWILCFMVMFFSAQAAADGWSTFKSRFMSSDGRISDTANNNVSHTEGQGYGMLLAVANDDRPTFDKLWQWTQTHLRNPQNDLFYWRYTPGATDPVADKNNASDGDVLIAWALQRGAQKWSASSYQQASDRIQRAIVKHNVITYAGHTVMLPGVQGFNKTSFIVLNPSYFLFPAWREFAQHSHLRVWNQLIDDGMDLLGDMHFGKSGLPLDWVALNADGSVAPAVGYSNRFSYDAIRIPLNIWWYDPQSLRLVPYQRVWQGYGRLTTPAWFDVLANTPAPYNLDGGLLAIRDLTLSETGYLSDRLAPDQNYFSASLQLLTWMAYQERR

SEQ ID NO: 391 - DNA, 1116 bp, Unknown
  Obtained from environmental sample
gtgatgaaagggtttcgctggtgtgtgatggcgatggtggtgatggcggcgacgaacgttcgcgccgcctgcacctggcctgcatgggagcagtttaaaaaggactatatcagcgaaggcgggcgcgtcattgatcccagtgacgcgcgcaaaatcagtacctcggaagggcaaagctacgcgctgttctttgccctcgcggcgaacgatcgccagacctttgatcggctgctgggctggacacgcgacaacctcgcgcagggcgatctgagccagcatctccccgcctggctgtggggaatgaaagaaaaagagaaagagacctgggcggtgatcgacagcaattccgcctcggatgccgatatctggattgcctggtcgctgctggaagcggggcgtttgtggaaagcgccggagtacacggccaccgggaaagcgctgctcaggcgcattgcccgtgaagaggtggtcaaggtgccgggcctggggctgatgctgctgcccggtaaagtcggctttgccgaagagaaatcctggcgcttcaacccgagctatctcccgccgcagctggcgaactatttcacccgttttggcgcaccctggaccacgcttcgcgaaaccaatttgcggctgctgctggaaaccgcgccaaaaggcttctcacccgactgggtgcagtatcaaaaaaataagggctggcaactgaagccagaaaaaacgtttatcggcagctacgacgcgattcgcgtctatctctgggcgggcatgttgcacgaccgggacccgcagaaagcgcggctgctggcacgttttaaacccatggcgacgcttacaacgaaaaaaggcgtaccccctgagaaagtcgatgtcgccagcggtaaaaccacgggcaatggcccggtcggtttctccgcctcactgctgccgtttttacaaaaccgcgatgcacaagcggtacaacgtcagcgtgtcgccgaccattttcccggtaatgacgcctattacagctacgtactgaccctgtttggacaaggatgggatcagcatcgttttcgtttcaccgcaaagggtgaattacaccctgactggggccaggaatgcgcaagttctcattaa

SEQ ID NO: 392 - protein, 371 aa, Unknown
  Obtained from environmental sample
  SIGNAL (1)...(22)
  DOMAIN (3)...(349): Glycosyl hydrolases family 8
MMKGFRWCVMAMVVMAATNVRAACTWPAWEQFKKDYISEGGRVIDPSDARKISTSEGQSYALFFALAANDRQTFDRLLGWTRDNLAQGDLSQHLPAWLWGMKEKEKETWAVIDSNSASDADIWIAWSLLEAGRLWKAPEYTATGKALLRRIAREEVVKVPGLGLMLLPGKVGFAEEKSWRFNPSYLPPQLANYFTRFGAPWTTLRETNLRLLLETAPKGFSPDWVQYQKNKGWQLKPEKTFIGSYDAIRVYLWAGMLHDRDPQKARLLARFKPMATLTTKKGVPPEKVDVASGKTTGNGPVGFSASLLPFLQNRDAQAVQRQRVADHFPGNDAYYSYVLTLFGQGWDQHRFRFTAKGELHPDWGQECASSH

SEQ ID NO: 393 - DNA, 1677 bp, Unknown
  misc_feature: Bacterial DNA
ttggtcatggagggaaagggacttctcatgcgtcgacgaagcgtctcgcttctcgggctcgccggtctgctggcggtgcccttgacggtgctgccccaggcacaggccgccgacggtctggtctccaccgggaaggcggtgacggcatcgtccgtggagacctcggccttcggggccggtctcgccgtggacggcaacgcggccacccgctgggcgagcctcgaaggggtcgacccgcagtggatccgcatcgacctcggagccgcccacacgatctcccgcgtcaagctcaactgggaggacgcgtacgggaaggcgtacaagatacagacctcggcggacggttcgacctggaccgacgtctactccaccaccgccggtgacggcgccaccgacgacctgacggtctccggcaccggtcgctacgtccggatgtacggcaccgggcgcggcaccgcctacggctactccctctgggagttcgaggtgtacggcgcgcccaccggcaccggcgggggcgggggcggctcggccgtccccttcggcagccacctcaggccctacaccgccggcaccctgaagccgtccggctcccaggcctcgatcgaccagaaggtcgtcgactactacaacaagtggaaggccgccttcgtccggcagaactgcggcaacggctggtaccagatcatctcgcccgacgccgaccacccctacgtcgccgaggcgcagggctacggcatggtcatcgccgccaccatggccggcgccgaccccgacgccaagaagatcttcgacggactcgtcaagtggaagatcgaccacccgtccgccgtcaacccgaacctgctcgccgccgaacaggacgtcaactgtcgcagcgtgaacggcggcgacggcgccaccgacggcgacatggacgtggcctacggcctgctcctcgccgacaagcagtggggcagcaccggcacctacaactacaaggacctcgcgctcaagcacatcgccgcgatcaagaaggacgaggtcaacccgacgaccaagctcctgaagctcggcgactggagcagctccggcgacgagtactactacatctcccggacctccgactggatggccgaccacttccgggccttccgggccgcgtcgggcgacaccacgtgggactccgtgcgctccgcgcaccagacccagatctcccggctccagtcgacgtacgcctccggcaccggactcctccccgacttcgtcgtcgacaccaacacgacgcccaagcccgccccgcgccaggtgctcgaggacccgaacgacggcgcgtactggtggaacgcctgccgcaccccgtggcgcatcgcggacgacgccgtgaccagcggggacgccacctcgctcgcggccgcccgcaagctgaacagctggatcaagacgaagaccggcggcgaccccaacaagatcgccatcggctacaagctcaacggcacccagatctcctcgggcagcgaggccgccttcttcgccccgttcgcggtggccgcgatgaccgactccggcagccaggcctggctggacgcgctgtggaacaagatggtggcgaccccggtcgacaccagcagctacttctccgcgagcatccagctccaggtcatgatcacggcatccggcaaccactgggtgccgtaa

SEQ ID NO: 394 - protein, 558 aa, Unknown
  DOMAIN (1)...(558): Bacterial protein
  SIGNAL (1)...(36)
  DOMAIN (46)...(161): F5/8 type C domain
  DOMAIN (179)...(553): Glycosyl hydrolases family 8
  SITE (498)...(501): N-glycosylation site. Prosite id = PS00001
MVMEGKGLLMRRRSVSLLGLAGLLAVPLTVLPQAQAADGLVSTGKAVTASSVETSAFGAGLAVDGNAATRWASLEGVDPQWIRIDLGAAHTISRVKLNWEDAYGKAYKIQTSADGSTWTDVYSTTAGDGATDDLTVSGTGRYVRMYGTGRGTAYGYSLWEFEVYGAPTGTGGGGGGSAVPFGSHLRPYTAGTLKPSGSQASIDQKVVDYYNKWKAAFVRQNCGNGWYQIISPDADHPYVAEAQGYGMVIAATMAGADPDAKKIFDGLVKWKIDHPSAVNPNLLAAEQDVNCRSVNGGDGATDGDMDVAYGLLLADKQWGSTGTYNYKDLALKHIAAIKKDEVNPTTKLLKLGDWSSSGDEYYYISRTSDWMADHFRAFRAASGDTTWDSVRSAHQTQISRLQSTYASGTGLLPDFVVDTNTTPKPAPRQVLEDPNDGAYWWNACRTPWRIADDAVTSGDATSLAAARKLNSWIKTKTGGDPNKIAIGYKLNGTQISSGSEAAFFAPFAVAAMTDSGSQAWLDALWNKMVATPVDTSSYFSASIQLQVMITASGNHWVP

SEQ ID NO: 395 - DNA, 1224 bp, Unknown
  Obtained from environmental sample
atgaaagtattccgaaattcgatcatccgtaagtcggtggtattgttctgtgctgttctatggatcttgccagccggattgtctctggcggccaacaagccgtttccccagcatacgtcttatacgagcggttcgattaaaccaaacaatgtaacgcagtcagcgatggacaatgcggtcaagagcaaatggaacagctggaaagggtctttcttgaagccggctgcgacaggacaatattacgtaaaatacaattcggcgggcgagacggtgtctgaggctcatggctacggaatgattttcaccgttctgatggcgggttacgacagtaacgcacagtcgtatttcgacggactttatcgctactataaggcgcatccgagtaataacaatccgtatctgatggcttggaaacagaacagcagctttcagaatatagagggagccaattcggcaacggatggcgatatggacattgcttacgcactcctgcttgcggacaagcagtggggaagcagtggatcgattaattatctccaggcagctaaggatatgatcaatgcgatcatgagtaatgacgttaatcagtcgcagtggacgctgcgcttaggcgattgggcaaccagtggcatcttcgataccgccacgcggccatcggatttcatgctgaaccatatgaaggcattccgtacggctaccggcgatgcccgttgggataacgtcatcaacaaaacctatacgatcatcaactccatctataacggttacagctccaataccggtttgcttccggatttcgttgtcatgtcgggcggcaattatcagcctgcggcagcggaattcctggagggggcgaacgacggaaaatactattacaactcggccaggactccttggcggattacgaccgactatctgatgaccggcgatacgcgcgcgctgaatcaattgaacaaaatgaacacgttcattaagtcggctgcgaacagcaatcctgccaatatcaaggcagggtataatctgaacggaactgcgctggtgacttataacagcggagcgttctatgcaccgttcggcgtaagcgcgatgacgtcgtccagccaccagagctggctgaattcggtatggaattatacggcgaacgcatctgcagagggttattatgaggagagcatcaagctgttctcgatgatcgtcatgtcgggaaattggtggacatattaa

SEQ ID NO: 396 - protein, 407 aa, Unknown
  Obtained from environmental sample
  SIGNAL (1)...(30)
  DOMAIN (33)...(402): Glycosyl hydrolases family 8
  SITE (50)...(53): N-glycosylation site. Prosite id = PS00001
  SITE (65)...(68): N-glycosylation site. Prosite id = PS00001
  SITE (142)...(145): N-glycosylation site. Prosite id = PS00001
  SITE (154)...(172): Glycosyl hydrolases family 8 signature. Prosite id = PS00812
  SITE (246)...(249): N-glycosylation site. Prosite id = PS00001
  SITE (347)...(350): N-glycosylation site. Prosite id = PS00001
  SITE (382)...(385): N-glycosylation site. Prosite id = PS00001
  SITE (386)...(389): N-glycosylation site. Prosite id = PS00001
MKVFRNSIIRKSVVLFCAVLWILPAGLSLAANKPFPQHTSYTSGSIKPNNVTQSAMDNAVKSKWNSWKGSFLKPAATGQYYVKYNSAGETVSEAHGYGMIFTVLMAGYDSNAQSYFDGLYRYYKAHPSNNNPYLMAWKQNSSFQNIEGANSATDGDMDIAYALLLADKQWGSSGSINYLQAAKDMINAIMSNDVNQSQWTLRLGDWATSGIFDTATRPSDFMLNHMKAFRTATGDARWDNVINKTYTIINSIYNGYSSNTGLLPDFVVMSGGNYQPAAAEFLEGANDGKYYYNSARTPWRITTDYLMTGDTRALNQLNKMNTFIKSAANSNPANIKAGYNLNGTALVTYNSGAFYAPFGVSAMTSSSHQSWLNSVWNYTANASAEGYYEESIKLFSMIVMSGNWWTY

SEQ ID NO: 397 - DNA, 738 bp, Unknown
  Obtained from environmental sample
gtgcgaggcaggatgaaaaattggcacggggctcagatcgacgtgaagagcgttcttcaacctggtaaatcttacgagctgacggtatgggtttaccaaaacagtggagaagatcaacgcatcacgctcaccatgcagcgaaaatacaacacggatgagaaaaccaactacgacactatcgtgtggcagagactcgttccttctggcaaatggaccgagatcaggggttcttactctgtgatgtccaacgtgaacgtcgaagaactctttttctacgttgaatcacccaatcccacgttggagtacaacatcgacgaggtggtgatcgtgaacaaaagtgtgatgtccatcgaaccagagtgggagattccttctttgaaagaggtgttcaaagatcgtttcagagtcggtgtggctttaccgtacagggtgctgatgaatccgctcgaaaggaggctcgtcagtaaacatttcaacagcataactgcggaaaacgagatgaaaccagagagcttactcgtctctgtgggtaaatacagctttctcagggcggacgaatatgtacgtttcgcccaagagcacggcttggtcgttcgagggcacacgctggtttggcacagccagaccccagagtggttcttcagagatgaaaccggcaaactcctctcgaaagatgccatgatcgaagggatgagacagtacatacacgacgtggtgggacacttcaaaggtaagatc

SEQ ID NO: 398 - protein, 246 aa, Unknown
  Obtained from environmental sample
  DOMAIN (2)...(112): Carbohydrate binding domain
  DOMAIN (125)...(246): Glycosyl hydrolase family 10
  SITE (112)...(115): N-glycosylation site. Prosite id = PS00001
MRGRMKNWHGAQIDVKSVLQPGKSYELTVWVYQNSGEDQRITLTMQRKYNTDEKTNYDTIVWQRLVPSGKWTEIRGSYSVMSNVNVEELFFYVESPNPTLEYNIDEVVIVNKSVMSIEPEWEIPSLKEVFKDRFRVGVALPYRVLMNPLERRLVSKHFNSITAENEMKPESLLVSVGKYSFLRADEYVRFAQEHGLVVRGHTLVWHSQTPEWFFRDETGKLLSKDAMIEGMRQYIHDVVGHFKGKI

SEQ ID NO: 399 - DNA, 2637 bp, Unknown
  Obtained from environmental sample
atgactagtggacgaaacacatgtgtgtgtctgttgttgattgtgctggcgatcggtcttctgtcaaagccaccggcgagcgcgcaaaatgaggcgccttataaagccacgctgacgatccggttggaccaaccgggagcggtgatcaatcgcaacatctacggccagtttgcggagcatctcggacgtttgatctacgacgggctctgggttggtgaaggatcgtcgatcccgaacacgcgcggattgcgtaacgacgtcgttacggcgttaaaagaattgcatgtgcctgtgctgcgttggcccggcggctgttttgccgacgagtatcactggcgtgacggcattggaccacgcgacaagcgtccgcggcggccgaacgcgagttggggcggcgtcgattcgaatgcgtttggcacgcatgagttcatggagctgtgcgagatgttgggcgcagacgcttatatcaatggcaacgtcggcagcggcacgccgcaggagatgatggaatggatcgagtacatgacttccgattccgattcggatctcgccaacctgcgccgtcgcaatggccgcgacaagccgtggaaggtgccgtatttcgccgtcggcaatgagacgtggggctgtggtggaaatatgcggccggagttttacgccgacgtgtatcgccagtacgccacgttcatcaagaaccattcaggcaatcgcattcagaaactcgcgagcggtggttacgacaacaattacaactggaccgaggtgctgatggcgcaggcggcgaagcagatcgatggcctgtcgttgcactattacacgctgcccaccggcaactgggacaagaaaggatcggcgacggaattcggcgaaagcgagtggcacgcgacgctcgccaggacgttgcgcatcgaggagttcattcagaagcacagcgcgatcatggacaagcacgatccgcagaagcgcgtcggtttgatggttgacgagtggggcacgtggtacgaccgcgacgagggccgcgacatgggcgcgctttatcagcagaacacgttgcgcgatgcggttgcggccggtatcaatctcaatatctttcacaagtatgccgatcgcgtgcgcatggcgaacatcgcgcagatggtgaacgtgttgcaggcgatggtgttgacggacaaagagaaaatggtgctgacgccgacgtatcacgtttttcggatgtatcgcgtgcatcagggagcgacgctgatcccggtcgaggttagtgcgccgcagtacacgctgggtggtgcgtctgtgccgtcgttgagcgtgtcggcttcgcgtgacggtgaaggacgggtgcatctgtcgatcgtgaatctcgatccagcgcgggcggcggagatcgatgcgaacggaccgttcagcagtgtcaagggagaagtattgactgcgccggcggtgaatgcgctgaatactttcgatcacccggatagtgtcaagcccgtgtcttttaatggatataaattagaaggctctaaattaatcctgaatattccggcgaaatccgtggtggtgttggaacttggaccacagaaacaagcaacgctcaaagatgcattcaaaaacgatttcatgatcggcgcggcgctcaaccggcgacagttcttcgaagaagacgctcgcggcgcagagatcgtgcgcatgcatttcaactcgatcacgccggagaacgtgttgaagtgggggctggtccatcccgaaccgaacaagtacgacttcaccgctcccgatcgcttcgtcgaattcggcgagaagcacggcatgttcgtcgtcggacacacgctcgtctggcataaccaaacgccgcgctgggtttttgaagacgaaaagaaacagccgctcgatcgcgagacgttgctgaaacgaatgcgcgatcacatcttcaccgtcgtcggccgttacaagggacgcattaaaggctgggacgtagtcaacgaggcgctgaatcaggatggcacgatgcggcagtcgccgtggttcaagatcatcggcgaggattatctcgtcaaagcgtttgagtttgcccacgaggccgatccagccgccgagctttattacaacgactacgatctcgagctgccggcgaagcgcgcaggcgccgtcgaactgctgaagaaactgaaagccgcgggtgtgtcgcttgctggtgtgggattgcagaaccacagtctcatggagtggccgtcagccgcagatgtggatgcgacgatcgcggcgttcgcgaatctgggtttgaaggttcacatcacggaactcgacgtcgacgtgctgccgcgcacgacgaaacccggtgcggattacgcagtcgacgtgaaggtgacgccgcagttgaacccgtatctcgacggcttaccggaggcgcgacagtcggcgttggcgaggcgttatgcggagctgtttcacgtgtttagaaaacatcgcgacgcgatcgagcgtgtgacgttctggggagttgcggacggcgattcgtggttgaacaactggcccatccgcggcaggacaaactatccgctgctcttcgatcgttccggccaaccgaaaccggcgttagcgtcggtgatcgaaaccgctaattattcaacggaacgtcgacggtga

SEQ ID NO: 400 - protein, 878 aa, Unknown
  Obtained from environmental sample
  SIGNAL (1)...(28)
  DOMAIN (328)...(515): Alpha-L-arabinofuranosidase C-terminus
  DOMAIN (528)...(870): Glycosyl hydrolase family 10
  SITE (128)...(131): N-glycosylation site. Prosite id = PS00001
  SITE (208)...(211): N-glycosylation site. Prosite id = PS00001
  SITE (235)...(238): N-glycosylation site. Prosite id = PS00001
  SITE (254)...(257): N-glycosylation site. Prosite id = PS00001
  SITE (745)...(748): N-glycosylation site. Prosite id = PS00001
  SITE (768)...(778): Glycosyl hydrolases family 10 active site. Prosite id = PS00591
  SITE (884)...(887): N-glycosylation site. Prosite id = PS00001
MTSGRNTCVCLLLIVLAIGLLSKPPASAQNEAPYKATLTIRLDQPGAVINRNIYGQFAEHLGRLIYDGLWVGEGSSIPNTRGLRNDVVTALKELHVPVLRWPGGCFADEYHWRDGIGPRDKRPRRPNASWGGVDSNAFGTHEFMELCEMLGADAYINGNVGSGTPQEMMEWIEYMTSDSDSDLANLRRRNGRDKPWKVPYFAVGNETWGCGGNMRPEFYADVYRQYATFIKNHSGNRIQKLASGGYDNNYNWTEVLMAQAAKQIDGLSLHYYTLPTGNWDKKGSATEFGESEWHATLARTLRIEEFIQKHSAIMDKHDPQKRVGLMVDEWGTWYDRDEGRDMGALYQQNTLRDAVAAGINLNIFHKYADRVRMANIAQMVNVLQAMVLTDKEKMVLTPTYHVFRMYRVHQGATLIPVEVSAPQYTLGGASVPSLSVSASRDGEGRVHLSIVNLDPARAAEIDANGPFSSVKGEVLTAPAVNALNTFDHPDSVKPVSFNGYKLEGSKLILNIPAKSVVVLELGPQKQATLKDAFKNDFMIGAALNRRQFFEEDARGAEIVRMHFNSITPENVLKWGLVHPEPNKYDFTAPDRFVEFGEKHGMFVVGHTLVWHNQTPRWVFEDEKKQPLDRETLLKRMRDHIFTVVGRYKGRIKGWDVVNEALNQDGTMRQSPWFKIIGEDYLVKAFEFAHEADPAAELYYNDYDLELPAKRAGAVELLKKLKAAGVSLAGVGLQNHSLMEWPSAADVDATIAAFANLGLKVHITELDVDVLPRTTKPGADYAVDVKVTPQLNPYLDGLPEARQSALARRYAELFHVFRKHRDAIERVTFWGVADGDSWLNNWPIRGRTNYPLLFDRSGQPKPALASVIETANYSTERRR

SEQ ID NO: 401 - DNA, 1242 bp, Unknown
  Obtained from environmental sample
atgctaaaagttttacgtaaacctattatttctggattagctttagctctattattgccggcaggggcagctggtgccgaaactaatatttcaaagaagccaaatataagtggattaaccgcgccgcaattagaccaaagatataaagattctttcaccattggtgctgcggttgagccgtatcaattattagatgcaaaagattcacaaatgctaaagcggcattttaatagtatcgtagcagagaatgtcatgaagcctagtagtttacagccagtagaaggacaattcaactgggagccggctgataaacttgttcagtttgcgaaggaaaatggaatggacatgcgaggtcatacgcttgtctggcatagccaggtaccggattggttctttgaagatgcggcaggaaatccaatggttgtttgggaaaatggcaggcaagtggttgccgatccatcaaagcttcaggaaaacaaagagctcttacttagccgattacaaaatcatattcaggcagtcgtaacgcgttataaagatgatataaaatcttgggatgttgtcaatgaagtaatcgatgaatggggcggacattctgaagggctgcgtcaatctccatggttcctcatcaccggaacggactatattaaagttgcttttgaaactgcaagagaatatgcagctccagacgctaagctgtatatcaatgattacaatacagaagtagaaccaaaaaggacgcacctttataacttagtaaaaagtttaaaagaagaacagaacgttccgattgatggtgttgggcatcagtctcacattcaaattggctggccttcagaaaaagaaattgaagatactattaatatgtttgcagatcttggtttagataaccaaatcaccgagcttgatgttagtatgtatggctggccggtaaggtcgtatccaacttatgatgcgatcccagaacttaaattcatggatcaagcagctcgttatgatcgtttatttaagttatatgagaaattaggagataaaatcagtaatgtgacattctggggtattgcggataaccatacatggctgaatgaccgcgcagatgtttactatgatgaaaatggaaatgttgtattagatagagaaacaccaagagtagaaagaggagcaggaaaagatgcgccatttgtatttgatcctgaatacaatgtaaaaccagcttattgggcaattatcgatcacaaataa

SEQ ID NO: 402 - protein, 413 aa, Unknown
  Obtained from environmental sample
  SIGNAL (1)...(26)
  DOMAIN (43)...(413): Glycosyl hydrolase family 10
  SITE (29)...(32): N-glycosylation site. Prosite id = PS00001
  SITE (35)...(38): N-glycosylation site. Prosite id = PS00001
  SITE (298)...(308): Glycosyl hydrolases family 10 active site. Prosite id = PS00591
  SITE (353)...(356): N-glycosylation site. Prosite id = PS00001
  SITE (362)...(365): N-glycosylation site. Prosite id = PS00001
MLKVLRKPIISGLALALLLPAGAAGAETNISKKPNISGLTAPQLDQRYKDSFTIGAAVEPYQLLDAKDSQMLKRHFNSIVAENVMKPSSLQPVEGQFNWEPADKLVQFAKENGMDMRGHTLVWHSQVPDWFFEDAAGNPMVVWENGRQVVADPSKLQENKELLLSRLQNHIQAVVTRYKDDIKSWDVVNEVIDEWGGHSEGLRQSPWFLITGTDYIKVAFETAREYAAPDAKLYINDYNTEVEPKRTHLYNLVKSLKEEQNVPIDGVGHQSHIQIGWPSEKEIEDTINMFADLGLDNQITELDVSMYGWPVRSYPTYDAIPELKFMDQAARYDRLFKLYEKLGDKISNVTFWGIADNHTWLNDRADVYYDENGNVVLDRETPRVERGAGKDAPFVFDPEYNVKPAYWAIIDHK

SEQ ID NO: 403 - DNA, 1158 bp, Unknown
  Obtained from environmental sample
atgagtcaactcgatttgaatctaaagctgttcaggcgagtgttttttgcgttggtgcttacgagcattattgcgtcagttctttcagcttcggttgcaagccaacagcagaacaccacactgaaggacgcctttaaaaagcacttcttgattggcgctgcgctcaaccggaaccagttttcagaaaaagatatgcgtggtgtttcgattatcactacgcagttcaatacgatcactgctgaaaaccaattgaagtggcagtcgatccaccctcaaccaaataagtacgacttcgagggaggcgatcaatttgtcgcgtttggcgagaaacacaagatggtcatcattggtcacacgcttgtctggcataaccagacgccgaagtgggtgtttcaagatgagaacggcggtcgcatatcaagagatgcgctcctcgaacgaatgcgcgatcacattcaaactgtcgttggccgttacaagggtcggatcaaaggttgggatgtagtcaacgaagcaatcaacgacgacggaaccatgcgcgagtcggaatggcagaagatcattggtaatgactatatcgagcgtgctttcaagtttgcacatgaagcagatccaaacgccgaactgtactacaacgactatgatctggaaggtcctccgaaacgcaagggtgctattgaactcatcaagaaactcaaagcggccggtgttgcgattcacggagttgggctccaggcacacagcatgatggattggccttccgtcgctgaacaggaacagacgattcttgatttcgccaatctcggcttacgcgtacacatcacagaaatggacctcgagatgttgcctcgtaaacagaaaaaccaggatgcggaaacgagctcgagtgtgacgttggacgagaagtggaatccttatgcgaagggtcttcccgatgacgtttctcaggcccaggcgaagcgttacgcggatttgtttgctgttttcgtcaagcatagcgacaagatcgatcgcgtgacgttctggggagttaccgatggcgattcgtggcttaacaactggccgatccgcggaagaacaaactatccgttgctattcgaccgcaccggaaaaccgaagccggccttttcagccgtaatccagaccgcgggtccctaa

SEQ ID NO: 404 - protein, 385 aa, Unknown
  Obtained from environmental sample
  DOMAIN (40)...(383): Glycosyl hydrolase family 10
  SITE (38)...(41): N-glycosylation site. Prosite id = PS00001
MSQLDLNLKLFRRVFFALVLTSIIASVLSASVASQQQNTTLKDAFKKHFLIGAALNRNQFSEKDMRGVSIITTQFNTITAENQLKWQSIHPQPNKYDFEGGDQFVAFGEKHKMVIIGHTLVWHNQTPKWVFQDENGGRISRDALLERMRDHIQTVVGRYKGRIKGWDVVNEAINDDGTMRESEWQKIIGNDYIERAFKFAHEADPNAELYYNDYDLEGPPKRKGAIELIKKLKAAGVAIHGVGLQAHSMMDWPSVAEQEQTILDFANLGLRVHITEMDLEMLPRKQKNQDAETSSSVTLDEKWNPYAKGLPDDVSQAQAKRYADLFAVFVKHSDKIDRVTFWGVTDGDSWLNNWPIRGRTNYPLLFDRTGKPKPAFSAVIQTAGP

SEQ ID NO: 405 - DNA, 1065 bp, Unknown
  Obtained from environmental sample
atggcaaccgcaacggtttccgcgcaaaatagcaacgcccccgcgttgagtctgaaagacgcgtatgccggcaaattcctgatcggttgtgcgggcgaggtgccggggcggctttccgcggaggaactggccaacatcaagttccattacaacgtcattacgcccgagaactcgatgaagccgcagccgacgcagcctaccgaagggacgtacaactttgcgacgcccgacgggctggtgaaatgggccggggagaataatctcaaagtctgggggcacacgctggcgtggcacgcgcaaaccggccggtggttcttcgagcccggggcggacggtcagcccgtgacgcgcgagctggcgatggaacgattgcgcaaacacatcatgaccgtggccggccattacaagggcaaggtcctgggctgggatgtcgtgaatgaatccatcgcggacggcggttcgggtgaaaccgagaatctgcgcaattccagttggtatcgggtcattgggccggacgtgctgaccatggcgttcaagtgggcgcacgaggccgaccccgacgcgcaactttactacaacgactacaatatcgagcagggcgcggtggcgaaccggggcaagcacgccagttcgctgctgctgctcaagcggctcatcgcggagggcgcgccgatccacggcgtcggcatccagggccactggcatctggacaccaatctcgcggatgtcgagaaagccatcgagaactacgccgccctggggctgcgcgtcgccatcacggaactggacgtgacggcgattggccggaacaccggggcgtttcaaaccgatgccggcaccaacgctgtgaccgccgaggcctttcaaaagcaggccgaggtttaccggaaattgttcgagattttcctgaagcacgagaagtccattgatcgcgtgacgttctggggcatcagtgaccggcgctcgtggcggtcccggcaatatccgttgttgttcgacgcgcaaatgcaacccaagccggccctgcaagcaattctggacgtcgcccaacggagccagccgtaa

SEQ ID NO: 406 - protein, 354 aa, Unknown
  Obtained from environmental sample
  DOMAIN (17)...(349): Glycosyl hydrolase family 10
  SITE (148)...(151): N-glycosylation site. Prosite id = PS00001
  SITE (164)...(167): N-glycosylation site. Prosite id = PS00001
MATATVSAQNSNAPALSLKDAYAGKFLIGCAGEVPGRLSAEELANIKFHYNVITPENSMKPQPTQPTEGTYNFATPDGLVKWAGENNLKVWGHTLAWHAQTGRWFFEPGADGQPVTRELAMERLRKHIMTVAGHYKGKVLGWDVVNESIADGGSGETENLRNSSWYRVIGPDVLTMAFKWAHEADPDAQLYYNDYNIEQGAVANRGKHASSLLLLKRLIAEGAPIHGVGIQGHWHLDTNLADVEKAIENYAALGLRVAITELDVTAIGRNTGAFQTDAGTNAVTAEAFQKQAEVYRKLFEIFLKHEKSIDRVTFWGISDRRSWRSRQYPLLFDAQMQPKPALQAILDVAQRSQP

SEQ ID NO: 407 - DNA, 1173 bp, Unknown
  Obtained from environmental sample
atggcgttttctaaggacaaagcatccttcaccaggcggagcgcgatcgcggccggactcgctgcgggtgtctccgcgtgcgtgacaccacaaccgggcgtcccggcaatgccctcgctcgatcagcttgccaagcgaagcggccgtcgcttcggttctgccgtcggatggggtcgccccggcgctgaccgcggcagcttcgccaacccggcctatgcagcaatcctcgaaaacgagtgctcgctcctcgtgcccgagaacgagctgaagtggcaatggacccgcccggggccggggcagttcgacttccgccagttcgacgccatcgccgattacgcctcgcgcaagggcctattgttgcgtggtcacacgctcttctggctgccggagaaatggtatcccaaatggctggtcgcccatgactttggggcgcagcccgctgcgaaagcggaagcgatgcttcgggagcatgtccagacggtgtgccgccggtacggcacacgcatctattcctacgacgtcgtcaacgaggcggtgcagccggaaacgggactgatccgcgatacggtcgtgacgaaggcgctcggtcacgaggcgactctggacgtgatgttccagaccgcgcgagccgaggctccgcacgcgcagctcgtctacaacgactacatgagctgggagcggaacagcgaggacgagacgcacatgcgcggcgtgctcaagttgctcgagggatttcggaagcgcggtaccccggtcgacgcactcggaatccagtcgcacatccggttactaaagccgctgacggtcgcggaaatcgtacgcgagtccgggggaccgtggcgccgcttcctcgatgaggtcgtcgccatgggctacaagcttgaaatcaccgaattcgacgtgaacgacaggctggcgccgacgaacccactggagcgcgatcggatggtcgccgactacgcgaaagcctatctcgacgtgatgctcagctatccgcagctgcgcgacatcatggcttgggggatggtcgaccgatacagctggctgaccggtttcgatccgcggaaagacaagacgctcaagcgcggcacgccttatgacaagcacttccgcccgaagctcttgcgtgaggcgattgcagcggcattcatgggggctgccgcgcccgcctga

SEQ ID NO: 408 - protein, 390 aa, Unknown
  Obtained from environmental sample
  SIGNAL (1)...(26)
  DOMAIN (39)...(383): Glycosyl hydrolase family 10
MAFSKDKASFTRRSAIAAGLAAGVSACVTPQPGVPAMPSLDQLAKRSGRRFGSAVGWGRPGADRGSFANPAYAAILENECSLLVPENELKWQWTRPGPGQFDFRQFDAIADYASRKGLLLRGHTLFWLPEKWYPKWLVAHDFGAQPAAKAEAMLREHVQTVCRRYGTRIYSYDVVNEAVQPETGLIRDTVVTKALGHEATLDVMFQTARAEAPHAQLVYNDYMSWERNSEDETHMRGVLKLLEGFRKRGTPVDALGIQSHIRLLKPLTVAEIVRESGGPWRRFLDEVVAMGYKLEITEFDVNDRLAPTNPLERDRMVADYAKAYLDVMLSYPQLRDIMAWGMVDRYSWLTGFDPRKDKTLKRGTPYDKHFRPKLLREAIAAAFMGAAAPA

SEQ ID NO: 409 - DNA, 630 bp, Unknown
  Obtained from environmental sample
atgaaggttacagcagcgttcgcgggcctcttggccacagtattggctgcccctgccgccgactctgctctggtggaacgggcgagtggtattaactatgtccagaattacaacggcaaccttggagacttcacgtacaatgagagtgcaggaacttattcgatgtactgggaaaacggagtcaatggagacttcgtcgttggcttaggctggagtactggtgctgcgcgctccattacctactctgcaaactataatgctgctagttctggctcctacctctcggtctatggctggataaactctccacaagctgaatactatatcgttgagaattatggcgattacaacccttgcagcggggctcagagcctgggtacccttacctctgatggtggcacctaccaagtctgcaccgacacacgttacaaccagccatccatcacgggaacgagcaccttcacgcagttcttctccgttcgacaaagcaagcgctcgtctggaactgtcacgactggtaaccatttcaatttctgggcccagcatggcttcgggaactcgtacaatttccaggtcatggcagtggaggcattcagtggcgcaggaagtgccactgttaccgtgtcttaa

SEQ ID NO: 410 - protein, 209 aa, Unknown
  Obtained from environmental sample
  SIGNAL (1)...(19)
  DOMAIN (27)...(208): Glycosyl hydrolases family 11
  SITE (47)...(50): N-glycosylation site. Prosite id = PS00001
  SITE (104)...(114): Glycosyl hydrolases family 11 active site signature 1. Prosite id = PS00776
MKVTAAFAGLLATVLAAPAADSALVERASGINYVQNYNGNLGDFTYNESAGTYSMYWENGVNGDFVVGLGWSTGAARSITYSANYNAASSGSYLSVYGWINSPQAEYYIVENYGDYNPCSGAQSLGTLTSDGGTYQVCTDTRYNQPSITGTSTFTQFFSVRQSKRSSGTVTTGNHFNFWAQHGFGNSYNFQVMAVEAFSGAGSATVTVS

SEQ ID NO: 411 - DNA, 666 bp, Unknown
  Obtained from environmental sample
atggttgcctttacttcccttctcgctggcttcgccgccattgccggagtcctgtctgctcccactgaatcctccgttgaggtggaaaagcgtcagaccattggacctggcaccggctacaacaatggctattactactcttactggaacgatggccatgctggcgtgacatacaccaacggtggcggcggttccttcaccgtcaactggtccaactctggcaactttgtcggaggcaagggatggcagccaggcaccaagaacaaggtcatcaacttctctggtagctacaaccccaacggaaacagctacctctccatctacggctggtctcgcaaccctctcatcgagtactacatcgttgagaactttggaacctacaacccatccactggtgccaccaagctgggtgaggttacatctgacggcagtgtctacgacatctaccgaactcagcgtgtcaaccagccctccatcatcggaaccgccaccttttaccagtactggtcggtccgccgcaaccaccgctccagcggctcggtcaacacggccaaccacttcaacgcctgggcttctcacggcctcactctcggcacgatggactaccagattgttgctgtggagggatactttagctctggctctgcttccatcactgtcagctaa

SEQ ID NO: 412 - protein, 221 aa, Unknown
  Obtained from environmental sample
  DOMAIN (39)...(220): Glycosyl hydrolases family 11
  SITE (70)...(73): N-glycosylation site. Prosite id = PS00001
  SITE (93)...(96): N-glycosylation site. Prosite id = PS00001
  SITE (115)...(125): Glycosyl hydrolases family 11 active site signature 1. Prosite id = PS00776
  SITE (208)...(219): Glycosyl hydrolases family 11 active site signature 2. Prosite id = PS00777
MVAFTSLLAGFAAIAGVLSAPTESSVEVEKRQTIGPGTGYNNGYYYSYWNDGHAGVTYTNGGGGSFTVNWSNSGNFVGGKGWQPGTKNKVINFSGSYNPNGNSYLSIYGWSRNPLIEYYIVENFGTYNPSTGATKLGEVTSDGSVYDIYRTQRVNQPSIIGTATFYQYWSVRRNHRSSGSVNTANHFNAWASHGLTLGTMDYQIVAVEGYFSSGSASITVS

SEQ ID NO: 413 - DNA, 2244 bp, Unknown
  Obtained from environmental sample
atgaaaaagagacaaggttttatcaaaaaagggctggttttgggcgtttcattgcttttgctggcgttgatcatgatgagcgccacatcgcaaacatcggccagtccacagaatccgtttttatggccttataatcaaccgacccacatcagctttaacgaagccgacgtgtatcaggcgtggacggtctggcgcgacgcgcagattacggcgaacaatgcggggggaaacggccgttaccgggtcatgggcggcgtggatggcggcagcaccgtctccgaagggcaggcttacggcattctcttcgcttccatctttgacgagcaaaccctgtttgacggtttgttcctgttcgccaaagaccactataacgaaaacggcgtcatggactggcatatcggcagccctggtgtgcgtattggcagcggcggcgccaccgacgctgaagtggacatggcgttaggattggtcaacgcctgcgtcaaagtgcagaaaaacgcctggcctgccagtccggccggcgtcaactactgcgtcgaagccactaacctgatcaacgccatttatacctacgaggtagaccatgccggcagtgcccctcctggcgggctgcccaacaatcagggcaacgaactgctgcccggtgatacctggaacatcagcgaactttatccacaaggcatcatcaacctctcctacttcccgcccggctatttcaccgttttcggcaagtttacgggcaacgaagccgcctggaacgccgtcatcaatcgcaactatcaggtggtggacatggtgcaggccaaaccgaataactgctccggactggtgcctaactggaataattacaacggcgacgcccaactcgtctcctggcagaccaacaattacagttggtggagctacgacgcggcccgtttcgcctggcgtattgccgtcgatcaggcctggtacggccgttctgaggccgccgaaaccatgaatgaaattggcggtttcttcagcagtaccggcttcaacaacatcggcgaacacaacatgaatgggcagcgggtgggcagtggtccctggcctttctttgtggcgaatgcggcggcggcggtgtgggcagcgcccaatgcaacggccgttaactgcggtacagccacaggttcgctgcaggaaagcgcccaatccgcttataaccgggtgctgaccagcaaagacacgcccaacagctactacggcaacgcctggcggctgttctctatgctgctcatgacgggcaacttccccaacttctacgaaatggccgacggcggcgtcacaccggttcccaccctgccgccgacccagacgccccacgccacccaaccgcctacggcgactgccaccacctcctccggcggcggcgtttgtgccgtggattacgtcattgccaaccagtggggcaatggcttccaggccaacgtcaccatcaccaatcacagcgccgtgccggtgaacggctacactctggcctggacccacgcgccggggcaggttgtcaccaacggctggaacgtgaccatcgcccaaagcggcagcgccgtcagcgccagcaatccggccagttattggaacggcgtgattggagccaacggcggcaaggtttcttttggtttccagggatctctggcaggcggcagcgcggtcgcgcccacttattttgccttgaacggcgctgcctgtaacggggccgtccttccgcccaccgccaccagtgcgccacccacacaaacggccgttccgcccaccgccaccacgatactgcccacacaaacggccgttccccctaccgccaccacgataccacccacacaaacggccgttccgcccaccgccaccagtcaaccaccgacgcaaacggccgttccccccaccgccacagctaccccgccatccggggttggcgcctgcaccgttgtctacgccatcaccaacgattggggcagcggcttcaccgccaacgtcaccctcaccaataaaagcagcgccgcccttaacggctggactctggcctatgccttccccggcaatcaaaccatcagcaatgcctggaacggaacggccgttcagtcaggtaaaaacgtcagcgtcaccaatgtaggttggaacggcagcctgccgcccaacggtgtcgccagctttggcttccaggcgagctacagcggtagtaacagcgctcctaccagctttacgctgaacgggcagcgatgcgattga

SEQ ID NO: 414 - protein, 747 aa, Unknown
  Obtained from environmental sample
  SIGNAL (1)...(34)
  DOMAIN (38)...(422): Glycosyl hydrolases family 8
  DOMAIN (466)...(570): Cellulose binding domain
  DOMAIN (646)...(746): Cellulose binding domain
  SITE (222)...(225): N-glycosylation site. Prosite id = PS00001
  SITE (233)...(236): N-glycosylation site. Prosite id = PS00001
  SITE (276)...(279): N-glycosylation site. Prosite id = PS00001
  SITE (300)...(303): N-glycosylation site. Prosite id = PS00001
  SITE (378)...(381): N-glycosylation site. Prosite id = PS00001
  SITE (490)...(493): N-glycosylation site. Prosite id = PS00001
  SITE (495)...(498): N-glycosylation site. Prosite id = PS00001
  SITE (521)...(524): N-glycosylation site. Prosite id = PS00001
  SITE (673)...(676): N-glycosylation site. Prosite id = PS00001
  SITE (678)...(681): N-glycosylation site. Prosite id = PS00001
  SITE (696)...(699): N-glycosylation site. Prosite id = PS00001
  SITE (704)...(707): N-glycosylation site. Prosite id = PS00001
  SITE (713)...(716): N-glycosylation site. Prosite id = PS00001
  SITE (722)...(725): N-glycosylation site. Prosite id = PS00001
MKKRQGFIKKGLVLGVSLLLLALIMMSATSQTSASPQNPFLWPYNQPTHISFNEADVYQAWTVWRDAQITANNAGGNGRYRVMGGVDGGSTVSEGQAYGILFASIFDEQTLFDGLFLFAKDHYNENGVMDWHIGSPGVRIGSGGATDAEVDMALGLVNACVKVQKNAWPASPAGVNYCVEATNLINAIYTYEVDHAGSAPPGGLPNNQGNELLPGDTWNISELYPQGIINLSYFPPGYFTVFGKFTGNEAAWNAVINRNYQVVDMVQAKPNNCSGLVPNWNNYNGDAQLVSWQTNNYSWWSYDAARFAWRIAVDQAWYGRSEAAETMNEIGGFFSSTGFNNIGEHNMNGQRVGSGPWPFFVANAAAAVWAAPNATAVNCGTATGSLQESAQSAYNRVLTSKDTPNSYYGNAWRLFSMLLMTGNFPNFYEMADGGVTPVPTLPPTQTPHATQPPTATATTSSGGGVCAVDYVIANQWGNGFQANVTITNHSAVPVNGYTLAWTHAPGQVVTNGWNVTIAQSGSAVSASNPASYWNGVIGANGGKVSFGFQGSLAGGSAVAPTYFALNGAACNGAVLPPTATSAPPTQTAVPPTATTILPTQTAVPPTATTIPPTQTAVPPTATSQPPTQTAVPPTATATPPSGVGACTVVYAITNDWGSGFTANVTLTNKSSAALNGWTLAYAFPGNQTISNAWNGTAVQSGKNVSVTNVGWNGSLPPNGVASFGFQASYSGSNSAPTSFTLNGQRCD

SEQ ID NO: 415 - DNA, 1107 bp, Unknown
  Obtained from environmental sample
atgaaaggctttcgctggtgtgtactcgcagtattgatgctggcggcaacgaatctacgcgccgcctgtagctggcctgcctgggaacagtttaaacaggactacatcagcgaaagcgggcgcgttatcgatcccagtgacgcgcgaaaaattaccacctctgaagggcaaagctatgcgctgttctttgccctggctgcaaacgatcgtaaagcgttcgatctgctgctggcgtggacgcgcgataatctcgccgggggcgatttaacggccaacctgcctgcctggctgtgggggcaaaaggacaaagagacctggacggttatcgatcctaactccgcgtccgatgctgatatctggattgcctggtcgctgctggaagcggggcggctgtggaaaaatcaggactacacccgcacaggcaaggggctgcttaaacgcatcgtcagcgaggaagtggtgaaagtgccgggtctgggcttcatgctgctgccgggtaaaaccggatttgccgaagagaacgcctggcgctttaaccccagctacctcccgccacagctagcgaactatttcacccgattgggtacgccgtggaccacgcttcgtgaaaccaatctgcgtttattgctggagacggcaccgaaaggtttctccccaaactgggtgcaatatcagaaaaacagaggctggcagctcagtcaggataaatcgctggtgggcagttacgacgccattcgcgtttatctctgggtgggcatgatgaatgataaagacccgcaaaaggctcggctgcttgcacgctttaagccaatggcaacggtaacggcaaagcagggcgtaccgccggagaaagtcgatgtcgcaaccggtaaacggacggataaaggtccggtcggtttttctgcctctctgctaccttttttacagaatcgggacgcgcaggcagtgcaacgacagcgcgtcgccgatcattttcctgataataatgcctattacagctatgtactgaccctctttgggcaagggtgggatcagcatcgttttcgcttcaccacacagggtgaattaataccgaattggggccaggaatgcgcaagttcacaataa

SEQ ID NO: 416 - protein, 368 aa, Unknown
  Obtained from environmental sample
  SIGNAL (1)...(22)
  DOMAIN (2)...(346): Glycosyl hydrolases family 8
MKGFRWCVLAVLMLAATNLRAACSWPAWEQFKQDYISESGRVIDPSDARKITTSEGQSYALFFALAANDRKAFDLLLAWTRDNLAGGDLTANLPAWLWGQKDKETWTVIDPNSASDADIWIAWSLLEAGRLWKNQDYTRTGKGLLKRIVSEEVVKVPGLGFMLLPGKTGFAEENAWRFNPSYLPPQLANYFTRLGTPWTTLRETNLRLLLETAPKGFSPNWVQYQKNRGWQLSQDKSLVGSYDAIRVYLWVGMMNDKDPQKARLLARFKPMATVTAKQGVPPEKVDVATGKRTDKGPVGFSASLLPFLQNRDAQAVQRQRVADHFPDNNAYYSYVLTLFGQGWDQHRFRFTTQGELIPNWGQECASSQ

SEQ ID NO: 417 - DNA, 1107 bp, Unknown
  Obtained from environmental sample
atgaatgtgttgcgtagtggactcgtgacgatgctgctgctggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggcatgttctttgccctggcggctaacgaccgtgcagctttcgataatcttctcgactggacgcagaacaatctcgctcagggttctttaaaagaacatttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcattgctaaaacgtatcgcgcgggaggaagtggtgacggtgcctgggctgggctccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggcttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccggtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaa

SEQ ID NO: 418 - protein, 368 aa, Unknown
  Obtained from environmental sample
  SIGNAL (1)...(21)
  DOMAIN (1)...(346): Glycosyl hydrolases family 8
MNVLRSGLVTMLLLAAFSVQAACTWPAWEQFKKDYISQEGRVIDPSDARKITTSEGQSYGMFFALAANDRAAFDNLLDWTQNNLAQGSLKEHLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 419 - DNA, 990 bp, Unknown
  Obtained from environmental sample
atgctggtgcgactgctgatagcgatgaccgtgctgttttctgcctttgcccacgccgatgcgtgggaaagctataaatcccggtttgtcatgcccgacgggcgcgtggtggataccggcaatggcaacgtttcgcataccgaaggccaggggtttgccatgctgatggcggtcagcctgaatgaccgccagacgtttgataagctttggcagtggaccaatgcgacgctaaaaaacaaagataacggcctgttttactggcgctataacccgaccgcggcggaccctatcaccgataaaaacgatgccaccgatggcgatatgatgatcgcctgggccttgctaaaggcgcagaaacagtggcgcgagaacagctacggtatcgcctcggacgagataacccgcgcgctactgaaacacacggtaataagctacgcgggctacagggtgatgctgccgggcgcgcacggcttcaatctcaacacccgcatcaacctgaacccttcctactttattttcccggcctggcaggctttcgccgaccgcacgcatctggtggtgtggcgcgatctgatgcgcgatggcaaaaagctcatcggcaaaatggggtggggtaatgccaatcttccgaccgactgggttgcgctgagcgctgacggcaaaatgaagcccgccgacgagtggaagccgcgtatgagctatgacgccgtgcgcattccgctgtacatccactggcaggacgcgcaaagcccactgttagcgccgtggaaagcgttctggcagcgctatcagcgtgaacaaacgcctgcgtgggtcaacgtgatgaccaacgaaacctctccttacccgatgaacggtggcctgctggcgattcgcgattacaccctgggcatcaacaccggcgagccgcaaattaccgcgcaggacgactactattccgcgagcctgaaaatgctgacgtggctggcggagcagtctgcgggacgctaa

SEQ ID NO: 420 - protein, 329 aa, Unknown
  Obtained from environmental sample
  SIGNAL (1)...(19)
  DOMAIN (1)...(326): Glycosyl hydrolases family 8
  SITE (43)...(46): N-glycosylation site. Prosite id = PS00001
  SITE (75)...(78): N-glycosylation site. Prosite id = PS00001
  SITE (104)...(122): Glycosyl hydrolases family 8 signature. Prosite id = PS00812
  SITE (281)...(284): N-glycosylation site. Prosite id = PS00001
MLVRLLIAMTVLFSAFAHADAWESYKSRFVMPDGRVVDTGNGNVSHTEGQGFAMLMAVSLNDRQTFDKLWQWTNATLKNKDNGLFYWRYNPTAADPITDKNDATDGDMMIAWALLKAQKQWRENSYGIASDEITRALLKHTVISYAGYRVMLPGAHGFNLNTRINLNPSYFIFPAWQAFADRTHLVVWRDLMRDGKKLIGKMGWGNANLPTDWVALSADGKMKPADEWKPRMSYDAVRIPLYIHWQDAQSPLLAPWKAFWQRYQREQTPAWVNVMTNETSPYPMNGGLLAIRDYTLGINTGEPQITAQDDYYSASLKMLTWLAEQSAGR

SEQ ID NO: 421 - DNA, 1044 bp, Unknown
  Obtained from environmental sample
atgaaagcaaatatcatattttgccttctggcgcctctggtagccgctctcccggccgaattcattcaactggagcctgaacttgccgcacgccgcgtcaatattactgagagaatggctgatttagaggatcgacaagcctctgtgagcattgatcagctcttcaaaaggaaaggcaaagtttattttggaactgcgactaaccgtggcttactccaacgagaacgaaatgcggccattatccaggctaatcttggccaagtgacgccagagaatagcatgaaatggcagtcccttgagtttaatcaaggccagtataattggggagatgcagattacctcgtcaacttcgctcaacaaaacggcaagacgatacgtggacatactctgatttggcactcacagctacctaattgggtcaataacatcaataatgcagatactttgcgccaagttatccgtactcatgttctcactgttgttggaagatataaaggcaagattcgcgcttgggatgtagtgaacgagatcttcaacgaggatggaacactacgctcttctgtgttttctagactgctgggcgaagagtttgtctcgattgctttccgtgctgctcgagaagctgatccgactgctcgtctctacatcaacgattacaatctcgatgttgccgggtctagtaaagtcaacttgatgagatactatgtggataaatggatctctcaaggagtccccattgacggaatcggaactcaaactcacatcggtgctggaggaggtgccgctgtacaaggtgcacttcagcagctggctacagcaccagtcactgaattggccattactgaacttgacatcgtgggcgcaccgtcgaacgattacaacgcagttgttcgaggatgtttgaatgttcctaagtgcttggggatcactgtgtggggtattagcgacaaagactcgtggcgttcaggctccagtccccttctattcgacagcaacttcaatcccaaagcagcgtacaacagtattgtaagcattttacaataa

SEQ ID NO: 422 - protein, 347 aa, Unknown
  Obtained from environmental sample
  SIGNAL (1)...(16)
  DOMAIN (50)...(346): Glycosyl hydrolase family 10
  SITE (34)...(37): N-glycosylation site. Prosite id = PS00001
MKANIIFCLLAPLVAALPAEFIQLEPELAARRVNITERMADLEDRQASVSIDQLFKRKGKVYFGTATNRGLLQRERNAAIIQANLGQVTPENSMKWQSLEFNQGQYNWGDADYLVNFAQQNGKTIRGHTLIWHSQLPNWVNNINNADTLRQVIRTHVLTVVGRYKGKIRAWDVVNEIFNEDGTLRSSVFSRLLGEEFVSIAFRAAREADPTARLYINDYNLDVAGSSKVNLMRYYVDKWISQGVPIDGIGTQTHIGAGGGAAVQGALQQLATAPVTELAITELDIVGAPSNDYNAVVRGCLNVPKCLGITVWGISDKDSWRSGSSPLLFDSNFNPKAAYNSIVSILQ

SEQ ID NO: 423 - DNA, 1335 bp, Unknown
  Obtained from environmental sample
gtgccgaccgggttgagggccaagccctgcctcacgcgctggctcgcggccagcgcctgcgcgctcgcgccgctgctgctcggcgcgcccgcgtccgcgcttgccgcgacggcgaacgcgaacgccaaaacgcctgctgcgaagacgacgtcggctgccgcgccgcaagcgcctgcctgcgcgtggtccgactggaccgcgttcaagggcgcgctgctgtccgccgacggacgcgtgatcgacgccagttcgccgcgtcaggtgacggtctccgaaggccagtcgtacgcgctcttcttcgcgctcgtcgcgaacgaccgcgcggccttcgacaagatcctcgcgtggaccgagaacaatctcgcccggggcgatctcgcggcgcatttgcccgcgtggatctgggggcgcaccgacatcgacgaaaacggcgcgccggtcgtggcttcggctgcgtcggccgcgtcgtccagccccgctacgcagacgcaaaccggcacgtggggcgtgatcgacaccaactccgccagcgacgccgatctctggatcgcctacacgctgctcgaagcgggccgcctctggaacgtgcgccgctacacggcgatcggcacggtgatggcgcgcaacgtcctgcgccgcgagacggccgcgctgcccggcctcggccgcacggtgctgcccggcccggtcggcttcacgctcgacaagaacacgtggcgtctgaacccgagctatgtgccgctgcaggtcatgcgccgcttcacgctcgcgatgcccgagaaagaacggcccgagtggaagtcgctgctcggcagttcgtcgaagctcgtcaacggcaccgcgcccaagggcttttcgcccgactgggtcgtctaccgcgcgcggggcaacaagggcgatttcggccctgacgaacccacgcacgccgaaagcgcctataacgcgatccgcgtctatctgtgggcgggcatgctcgcttacgacgacccggcgcgcagcgcgacgctcgcgaccttcgcgccgctctcggccttcgtggccgcgcacggctttccgcccgagcgcgtcaacacgcagaccggcgaacccggcccgaacgagggcaacggcggcttttcggcggcggtcgcgccgtatctgtcggcactcggccgcaccgatctgtccgatgcgcaggttcaacgcagccgcacgctcgcgcaaaaatcgccgcccggctattacagcagcgtgctgatgctgttcggcctcggctatctgcaaggcctttatcgcttcgatgcgcaaggccgcgtaattcccgcatggacggctcaatgcccggcagcacgatga

SEQ ID NO: 424 - protein, 444 aa, Unknown
  Obtained from environmental sample
  SIGNAL (1)...(35)
  DOMAIN (38)...(422): Glycosyl hydrolases family 8
  SITE (282)...(285): N-glycosylation site. Prosite id = PS00001
MPTGLRAKPCLTRWLAASACALAPLLLGAPASALAATANANAKTPAAKTTSAAAPQAPACAWSDWTAFKGALLSADGRVIDASSPRQVTVSEGQSYALFFALVANDRAAFDKILAWTENNLARGDLAAHLPAWIWGRTDIDENGAPVVASAASAASSSPATQTQTGTWGVIDTNSASDADLWIAYTLLEAGRLWNVRRYTAIGTVMARNVLRRETAALPGLGRTVLPGPVGFTLDKNTWRLNPSYVPLQVMRRFTLAMPEKERPEWKSLLGSSSKLVNGTAPKGFSPDWVVYRARGNKGDFGPDEPTHAESAYNAIRVYLWAGMLAYDDPARSATLATFAPLSAFVAAHGFPPERVNTQTGEPGPNEGNGGFSAAVAPYLSALGRTDLSDAQVQRSRTLAQKSPPGYYSSVLMLFGLGYLQGLYRFDAQGRVIPAWTAQCPAAR

SEQ ID NO: 425 - DNA, 1221 bp, Unknown
  Obtained from environmental sample
atgttgcagactattgcattaatttttcttgcccttgttattctgatcgcgctgcttatcagttttagacgcagccgcaccatcggcaaatacctgggttatgcaggcggggccgcgttatttattgcagcggtggtttatggctattttatgaggcccatcactataccgccggcaccggtactggaagctcaagccatcgaacccgagacccgcgcggcattaacggcattggatttttatctgggtgcaggcacctatacggttgacgatataaagcaccacgccttcacggatttatttaactcctataccgcgatcaatgcactgaagattggcgctgtgctcacagagattaatcagaaaatctatgacttcacgcaagcggatcgctttattgatgaagctttgcatcaaggtttacgcatccgcggccatgcccttgtgttcggcaaactgagcgatatttatgaagaaccgaatttgcaaacctggctggatacatactatcgcgatgacgcagacaagcgtcaggctttgcaagaattggtggatcatcatattgatactatggtgacgcgctaccagggcaggatcacgcagtgggatgtggtgaacgagccattggggttgtttgggcaaggcgagctggaagataacgtgtttttgcgaaatctgggacctgattatattgccaatgcgtttaaacgggcgcacctcgctgacaatcaggcaaggttatttttaaacgaacaatttgatcgctacaccgggcccagagccgatgcatttatcgcattagtcaaacacttaaagtcacaaggagtgccgatacacggtgtgggtctggagcatcatatgttgttcacgctcgcgccgcgtgaagaaaccaaagcgtttattcaacggttgtcagccttgggcgttgatgttgaaattaccgaactggatgcgcgccttcgtctgtttgctgatgcagaaaatccgcatctggcccaggcggaatattaccgggatatcatgaccgcctgcctcgacatcaaagcttgcaaaggcgtcacgttctggggtttgcacgaccaggacgcgtggcacaaagatttgccgtggatgtttgcaacgcctaatgatccctatttgtttgaccagaataaaaatcccaagattgcggcgaaactgatttccgaaaccatagtgcaatgggatgcaaatgcgcggtag

SEQ ID NO: 426 - protein, 406 aa, Unknown
  Obtained from environmental sample
  DOMAIN (71)...(398): Glycosyl hydrolase family 10
MLQTIALIFLALVILIALLISFRRSRTIGKYLGYAGGAALFIAAVVYGYFMRPITIPPAPVLEAQAIEPETRAALTALDFYLGAGTYTVDDIKHHAFTDLFNSYTAINALKIGAVLTEINQKIYDFTQADRFIDEALHQGLRIRGHALVFGKLSDIYEEPNLQTWLDTYYRDDADKRQALQELVDHHIDTMVTRYQGRITQWDVVNEPLGLFGQGELEDNVFLRNLGPDYIANAFKRAHLADNQARLFLNEQFDRYTGPRADAFIALVKHLKSQGVPIHGVGLEHHMLFTLAPREETKAFIQRLSALGVDVEITELDARLRLFADAENPHLAQAEYYRDIMTACLDIKACKGVTFWGLHDQDAWHKDLPWMFATPNDPYLFDQNKNPKIAAKLISETIVQWDANAR

SEQ ID NO: 427 - DNA, 996 bp, Unknown; identical to SEQ ID NO: 49
  Obtained from environmental sample

SEQ ID NO: 428 - protein, 331 aa, Unknown; identical to SEQ ID NO: 50
  Obtained from environmental sample
  DOMAIN (7)...(330): Glycosyl hydrolase family 10
  SITE (2)...(5): N-glycosylation site. Prosite id = PS00001
  SITE (237)...(247): Glycosyl hydrolases family 10 active site. Prosite id = PS00591

SEQ ID NO: 429 - DNA, 1107 bp, Unknown
  Obtained from environmental sample
atgaatgtgttgcgtagtggaatcgtgacgatgctgctgttggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggtatgttctttgccctggcggctaacgaccgtgtagctttcgataatattctcgactggacgcagaacaatctcgctcagggctctttaaaagaacgtttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcgttgctaaaacgtatcgcgcgggaggaagtggtgacggtgcctgggctgggttccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggtttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccggtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaa

SEQ ID NO: 430 - protein, 368 aa, Unknown
  Obtained from environmental sample
  SIGNAL (1)...(21)
  DOMAIN (1)...(346): Glycosyl hydrolases family 8
MNVLRSGIVTMLLLAAFSVQAACTWPAWEQFKKDYISQEGRVIDPSDARKITTSEGQSYGMFFALAANDRVAFDNILDWTQNNLAQGSLKERLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 431 - DNA, 984 bp, Unknown
  Obtained from environmental sample
atggttcaaatcaaagcagctgctctggctgttcttttcgccagcaatgtgctctccaaccccatagagccccgccaggcctcggtgagcatcgatgccaaattcaagacgcacggcaagaagtacctgggcaccatcggcgaccagtacactctcaacaagaacgcaaagaccccggcgatcatcaaggccgactttggccagctgactccggagaacagcatgaagtgggatgctactgagcccaaccggggacagttctccttctcggggtcggattacctggtcaacttcgcccagtctaacggaaagctgatccgtggccacactctcgtctggcactcacagctcccgtcctgggtgcagtcaatctccgataagaacaccctgatccaagtcatgcagaaccacatcaccaccgtgatgcagcgctacaagggcaaggtctacgcctgggacgttgtcaatgagatcttcaacgaggatggctctcttcgccagagtcacttctacaacgtcatcggtgaggactatgtgcgcatcgctttcgagaccgctcgcgcggtggatcccaatgccaagctttacataaacgactacaacctggattccgcctcgtacccgaaattgaccggcctggtcaaccacgtcaagaagtgggtcgcagctggcgtccccatcgacggaattggttcccaaacccacctgagcgcgggtgccggcgctgccgtctcaggagctcttaatgctctcgccggtgcaggcaccaaggaggtcgctattaccgagctcgacatcgctggcgctagctccaccgactacgtgaacgtcgtcaaggcgtgtctgaaccagcccaagtgcgtcggtatcaccgtctggggagttgctgaccccgactcgtggcgctccagctccagccctctgctcttcgacagcaactacaaccccaaggctgcttataccgctattgcgaacgctctgtag

SEQ ID NO: 432 - protein, 327 aa, Unknown
  Obtained from environmental sample
  SIGNAL (1)...(19)
  DOMAIN (30)...(327): Glycosyl hydrolase family 10
MVQIKAAALAVLFASNVLSNPIEPRQASVSIDAKFKTHGKKYLGTIGDQYTLNKNAKTPAIIKADFGQLTPENSMKWDATEPNRGQFSFSGSDYLVNFAQSNGKLIRGHTLVWHSQLPSWVQSISDKNTLIQVMQNHITTVMQRYKGKVYAWDVVNEIFNEDGSLRQSHFYNVIGEDYVRIAFETARAVDPNAKLYINDYNLDSASYPKLTGLVNHVKKWVAAGVPIDGIGSQTHLSAGAGAAVSGALNALAGAGTKEVAITELDIAGASSTDYVNVVKACLNQPKCVGITVWGVADPDSWRSSSSPLLFDSNYNPKAAYTAIANAL

SEQ ID NO: 433 - DNA, 1131 bp, Unknown
  Obtained from environmental sample
atgaacacactcctaccacggcggcgactgtggtcctccacggcgatcctgcgcacgctggcggccggggcgctggcggccggtatggtcctggcacccgtcagtgccgccaacgcggccaccaccctcggtgcctcggcggcggagaagggccggtacttcggtgcggccgtcgggacgtacaagttcaacgacagcacctacatgtcggtgctgaaccgcgagttcaacagcctggtcgccgagaacgagatgaagtgggacgcgaccgagccccagcgcggcgtgttcaactacagcgccggggaccgcatcgtcaaccacgcccgatcccagggcatgaaggtacgcggacacgccctgttgtggcacgcccagcagccacgctggacggagggcctgtccggcggcgacctgcgcaacgccgcgatcaaccatgtcacccaggtggccagccacttccgggggcagatctactcctgggacgtggtgaacgaggctttcgccgacggtggcagcggtgcccggcgggactcgaacctccagcgcaccggcaacgactggatcgaggcggcgttccgtgccgcccgggcagccgatcccaacgccaagctctgctacaacgactacaacaccgacgggatcaacgcgaagtccaccggcgtctacaacatggtgcgtgacttcaagtcccgtggggtgccgatcgactgcgtgggcttccagtcacacctgggcaccaccctccccggtgactaccaggccaaccttcagcgcttcgccgacctgggcgtcgacgtggagatcaccgagctggacatcacccagggcggaaaccaggccaacatgtacggcgccgtcacccgcgcctgcctggcgatctcgcgctgcaccggcatcaccgtgtggggggtacgggactgcgactcctggcgtggtggggacaacgccctgctgttcgactgcgccggcaacaagaagcccgcgtacacggccgtcctcgacgccctcaacagcggctcgaacccgaaccccaaccccaccggcaaccggctgcgcaacgaggcctccggtcgatgcctggacgtcaacggcgcaagctccgccaacgggtcacaaatgatccaaaga

SEQ ID NO: 434 - protein, 377 aa, Unknown
  Obtained from environmental sample
  SIGNAL (1)...(39)
  DOMAIN (42)...(337): Glycosyl hydrolase family 10
  SITE (99)...(102): N-glycosylation site. Prosite id = PS00001
  SITE (268)...(278): Glycosyl hydrolases family 10 active site. Prosite id = PS00591
  SITE (375)...(378): N-glycosylation site. Prosite id = PS00001
MNTLLPRRRLWSSTAILRTLAAGALAAGMVLAPVSAANAATTLGASAAEKGRYFGAAVGTYKFNDSTYMSVLNREFNSLVAENEMKWDATEPQRGVFNYSAGDRIVNHARSQGMKVRGHALLWHAQQPRWTEGLSGGDLRNAAINHVTQVASHFRGQIYSWDVVNEAFADGGSGARRDSNLQRTGNDWIEAAFRAARAADPNAKLCYNDYNTDGINAKSTGVYNMVRDFKSRGVPIDCVGFQSHLGTTLPGDYQANLQRFADLGVDVEITELDITQGGNQANMYGAVTRACLAISRCTGITVWGVRDCDSWRGGDNALLFDCAGNKKPAYTAVLDALNSGSNPNPNPTGNRLRNEASGRCLDVNGASSANGSQMIQR

SEQ ID NO: 435 - DNA, 1116 bp, Cochliobolus heterostrophus ATCC 48333
caatctcccctgtacggccaatgtggtggtactggatggaccggtcccacaacatgcgtttccggcgcggtgtgtaacaaagtcaatgatttctattcccagtgcgttcctggtacgggtggcgggtctcccgctcccactactactggcaacagtaaccctgctcctactggaggcaatggtggaggaggctcaggagctgcaggtggattgcacgaaaaattcaaggccaagggaaagatctactatggcactgaaatcgaccactaccatctgaacaacgcccccctcatgacgattgccaagaacagcttcggacagatcacgcacgagaacagcttgaagtgggatgctactgaaccatcacgtggacaattctcgtttaccaatgccgacaaggtcgtcagctgggctacccagaacggaaagctcatgcgtggtcacacactgctctggcactcgcagctgccgtcgtgggttacgcagatcaacgaccgcgctaccctgacctccgtcatccagaaccacgtgacacagatcgtcacccactacaagggcaagatcttgcagtgggacgtcgttaacgagatctttgctgagaacggccaacttcgagacagtgtctttagtcgtgtcctcggcgaagactttgttggtatcgctttccgcgccgcacgcgccgctgatcccaacgctaagctctacatcaacgactacaacttggacagtgccaactacgccaaggtcaccacgggtatggtcgcacacgttaacaagtggatatcccaaggtatccccattgatggcattggcacacaggcccatcttgccgcacctggcggctggaacccagcttccggcgtccccaacgccctcaaggcactggccgccgccaatgtcaaggagattgccattacggagcttgatatcgccggcgccgcagcaaacgacttcctcaccgtcatgaacggttgtcttgccgtctcaaagtgtgttggtatcaccgtctggggtgtctccgacaaggacagctggcgcgccaacgaccgccctctcttgttcgacaccaactaccagccaaagcaggcctacaacacccttgttggagctttgtaa

SEQ ID NO: 436 - protein, 371 aa, Cochliobolus heterostrophus ATCC 48333
  DOMAIN (4)...(32): Fungal cellulose binding domain
  DOMAIN (70)...(371): Glycosyl hydrolase family 10
  SITE (8)...(35): Cellulose-binding domain, fungal type. Prosite id = PS00562
QSPLYGQCGGTGWTGPTTCVSGAVCNKVNDFYSQCVPGTGGGSPAPTTTGNSNPAPTGGNGGGGSGAAGGLHEKFKAKGKIYYGTEIDHYHLNNAPLMTIAKNSFGQITHENSLKWDATEPSRGQFSFTNADKVVSWATQNGKLMRGHTLLWHSQLPSWVTQINDRATLTSVIQNHVTQIVTHYKGKILQWDVVNEIFAENGQLRDSVFSRVLGEDFVGIAFRAARAADPNAKLYINDYNLDSANYAKVTTGMVAHVNKWISQGIPIDGIGTQAHLAAPGGWNPASGVPNALKALAAANVKEIAITELDIAGAAANDFLTVMNGCLAVSKCVGITVWGVSDKDSWRANDRPLLFDTNYQPKQAYNTLVGAL

SEQ ID NO: 437 - DNA, 993 bp, Unknown
  Obtained from environmental sample
atgcgaaaacccgcatgcgccaccctggctgtcatgatgagtttgctgttcactcctttctctcaggcaggtcaggcctgggagagttacaaagcgcgcttctttaagccggatgggcgaatcgtcgataccggcaacggtaacgtttcccataccgaaggccagggttttgccatgctgatggcggtggcaaacgatgataaagcgacctttgataaactctggcactggacgagcagtacgctgaagaataaagagaacggtcttttttactggcgttataatcccgctcaggcagacccgattgccgacaaaaacaatgcctccgatggcgatgtgctcattgcctgggctctgttaaaagcgaacgcgcgctggcatgacaaaggctacagcacggcatcggatgccattaccaaagcgctgcttgcccataacgttatccgctatgcgggttaccgcgtgatggtgcccggctcacacgggtttaagcaggacaataacgttgtgcttaatccttcctacttcgtatttcctgcctggcaggcatttgctgagcgcagccatttgcaaatatggcgacagctcgcgcaggacggacagcggctgctgaagaaaatggggacgggtaaagccaatctgccaactgactgggtctctcttgacacgaaagggacgctggcccccgcaaacgcctggccgccccgcatgagttatgacgccatccgcattccgctgtacatcagctggtccaacgcgaaaagccccttgctgaccccgtggcgcgcctggttcgctcagtttccgcgtgaacaaacacccgcatgggttaacgtcacgacgaatgaatacgccccctacatgatggctggcggtctgctggcagtgcgtgatttaacgatgggacagagggtcggcgagcccgacattactgcaaatgatgattactattcggcaagtctgaaaatgctggtgtggatctcagaacaataa

SEQ ID NO: 438 - protein, 330 aa, Unknown
  Obtained from environmental sample
  SIGNAL (1)...(23)
  DOMAIN (1)...(329): Glycosyl hydrolases family 8
  SITE (48)...(51): N-glycosylation site. Prosite id = PS00001
  SITE (108)...(111): N-glycosylation site. Prosite id = PS00001
  SITE (109)...(127): Glycosyl hydrolases family 8 signature. Prosite id = PS00812
  SITE (282)...(285): N-glycosylation site. Prosite id = PS00001
MRKPACATLAVMMSLLFTPFSQAGQAWESYKARFFKPDGRIVDTGNGNVSHTEGQGFAMLMAVANDDKATFDKLWHWTSSTLKNKENGLFYWRYNPAQADPIADKNNASDGDVLIAWALLKANARWHDKGYSTASDAITKALLAHNVIRYAGYRVMVPGSHGFKQDNNVVLNPSYFVFPAWQAFAERSHLQIWRQLAQDGQRLLKKMGTGKANLPTDWVSLDTKGTLAPANAWPPRMSYDAIRIPLYISWSNAKSPLLTPWRAWFAQFPREQTPAWVNVTTNEYAPYMMAGGLLAVRDLTMGQRVGEPDITANDDYYSASLKMLVWISEQ

SEQ ID NO: 439 - DNA, 1041 bp, Unknown; identical to SEQ ID NO: 61
  Obtained from environmental sample

SEQ ID NO: 440 - protein, 346 aa, Unknown; identical to SEQ ID NO: 62
  Obtained from environmental sample
  DOMAIN (10)...(335): Glycosyl hydrolase family 10
  SITE (185)...(188): N-glycosylation site. Prosite id = PS00001
  SITE (240)...(250): Glycosyl hydrolases family 10 active site. Prosite id = PS00591

SEQ ID NO: 441 - DNA, 1239 bp, Unknown
  Obtained from environmental sample
atgctaaccgatagcgaaattcgtaagcatcgcctgacccgcgccactctcacgctcatgcatcagggcgtgccgctggcgggtcaagatgtcgttgtatctcaaaaaaaacatgcctttctctttggtagcaattggggcgaaagcaccatcccgctggtcaatggcgaactgacaggccgtgaaaaagaactggcagaacggcgcaacgagtattttttgcagttttttaaccaggctactttgccattttactgggcgcgtttcgagccgcggcggggccagcccgatactgttcgaattatgaatgcggcccgctggtatgcccggcagggctgcgttctgaagggacatccgctctgctggcataccctcaccgccgactggctgctggagatgagcaacgaacaaattctcgaatcccagttggcgcgtattcggcgcgatgtgaccgatttttccggggtcatcgagacctgggatgtagtgaacgaagcggtcatcatgccaattttcgacaaatatgataatggcgtgacgcgcttgtgcaaacagatggggcgcatcgggctgattcgcgtcatgttcgaggcagctcgcgccgctaacccgcgcgccattctgattttgaatgatttcgacatttcgcctgcttacgatttgctggttgaagaatgtctggcggccggcgttccgattgatgtaattggcatccaatcgcacatgcaccagggctactggggcgtagaaaaaacgcaggaaattctctctcgtttcgagcgtttcaacttgccaattcaattcagcgagaccacaattgtctctggtcatctcatgccgcctgaaattgttgatttgaatgattaccaggtgagcgagtggcccagcacccccgagggcgaggagcgccaggctcgcgaggtggtcacgcattacaaaaccctgctctcgcacccgctggtaaccggaatcacctggtgggatatgacggatggtggctggctcaatgcaccggcaggactgttgcgccaggaccaatctcccaagcccgcttatgacgagttgctcaaactggtcaagggcgagtggtggctttccccgacccgcctgaccactaattctgccggacaactgaccctcgaaggctttcctggcgaatacgaatcatcgttcgacaagcagaaattcgttttttcgctgggttctaaaaccgaaacggaaatttttgttcatttttga

SEQ ID NO: 442 - protein, 412 aa, Unknown
  Obtained from environmental sample
  DOMAIN (49)...(359): Glycosyl hydrolase family 10
MLTDSEIRKHRLTRATLTLMHQGVPLAGQDVVVSQKKHAFLFGSNWGESTIPLVNGELTGREKELAERRNEYFLQFFNQATLPFYWARFEPRRGQPDTVRIMNAARWYARQGCVLKGHPLCWHTLTADWLLEMSNEQILESQLARIRRDVTDFSGVIETWDVVNEAVIMPIFDKYDNGVTRLCKQMGRIGLIRVMFEAARAANPRAILILNDFDISPAYDLLVEECLAAGVPIDVIGIQSHMHQGYWGVEKTQEILSRFERFNLPIQFSETTIVSGHLMPPEIVDLNDYQVSEWPSTPEGEERQAREVVTHYKTLLSHPLVTGITWWDMTDGGWLNAPAGLLRQDQSPKPAYDELLKLVKGEWWLSPTRLTTNSAGQLTLEGFPGEYESSFDKQKFVFSLGSKTETEIFVHF

SEQ ID NO: 443 - DNA, 912 bp, Unknown
  Obtained from environmental sample
atgaagatgacctacatgcatccggctgaagatacttactcgtttggtcaagcggatcagttggtcaactgggcgaaagcgaatggtattggcgtgcacggccacactctggtttggcactccgaataccaggtacccaattggatgaaaaattactctggtgatgcaactgcattccaaaccatgctcaacacccatgtgaaaactgtggctgagcattttgctggcgaactggacagctgggacgttgtgaatgaagtgctggagccgggctccaatggttgctggcgtgaaaactctctgttctaccagaagcttggcaaagactttgtcgcgaacgcattccgtgcagctcgcgagggtgatcccaatgcagacttgtattacaacgattactcgactgaaaatggtgtaacttccgatgcgaagttcagttgtttgttggaactagtcgataagcttctggaagcggacgtgccgattacaggtgtgggtttccaaatgcacgtgcaggcgacgtggcctagcaatgccaacatcggcaaggcattcaaagccatcgcggatcgcggtctgaaagttaaaatttctgagctcgatgttcctgttaacaacccttacggaaccactaatttcccgcaatacagcagttttaccgcggaagccgccgagctgcaaaagcagcgctacaagggcattatgcaagcgtaccttgataacgtaccggccaacctgcgtggtggtttcaccgtgtggggcgtttgggatggcgatagctggatcatgacgttcagccagtacaccaacgctaacgccaacgactggccactgttgttcaccggcccgcagaatggtccatacgaagcgaagcctgcgtactacggcgtattggaagccctgatgggtcagtaa

SEQ ID NO: 444 - protein, 303 aa, Unknown
  Obtained from environmental sample
  DOMAIN (1)...(300): Glycosyl hydrolase family 10
  SITE (51)...(54): N-glycosylation site. Prosite id = PS00001
MKMTYMHPAEDTYSFGQADQLVNWAKANGIGVHGHTLVWHSEYQVPNWMKNYSGDATAFQTMLNTHVKTVAEHFAGELDSWDVVNEVLEPGSNGCWRENSLFYQKLGKDFVANAFRAAREGDPNADLYYNDYSTENGVTSDAKFSCLLELVDKLLEADVPITGVGFQMHVQATWPSNANIGKAFKAIADRGLKVKISELDVPVNNPYGTTNFPQYSSFTAEAAELQKQRYKGIMQAYLDNVPANLRGGFTVWGVWDGDSWIMTFSQYTNANANDWPLLFTGPQNGPYEAKPAYYGVLEALMGQ

SEQ ID NO: 445 - DNA, 1191 bp, Unknown
  Obtained from environmental sample
atgaaaaatataatattaaacttatctcccgtcgtttttgcactgctgatattgactgccgcatgtgaacctgtgcaagaagagaatacctcgctgtcgcttgatccaccattgtatgaggtttatgaggacgcatttcttctgggtacgatccttaacagggcccagatctacgccgacggcggtgaagtcccggttgaggtcgtgcgtcaggaccggcgcggctattttgtggagcgtcaggtcatcccgcagccggaaggcctgaaactcggcctgcatcatttcaatcaggttaccgctgagaatgtcatgaaatgggaggaaatccacccggaacccggagtgtatgacttcgatgcggctgaccggctggtggatctcgcggaagccaacgggatgcacatcaccggacacgccctggtatggcacaaccagacaccagactgggtatttgaagatgacaacggccagccaattgatcgcgacgcattgctggaaaggatgcgcgatcatattcatacggttgttggaagatacgccggacgtgtccactcatgggatgtggtcaacgaggccgtcagtgaagatggtggtttccgccagacccgctggcttgaaataattggagatgatttcattgtcagggcttttgaatacgcgcatgaagccgatccggaagcacgcctgtattacaacgactacaatatggagactaatccggtcaagcgtcagggtgcgatcgatattgtgcggaatgtcatggacagcggtgtcccggttcacggtatcggaacccagagccatctgaacctcctcagctttccggaccttgccgaagtagaacaggctattatcgattttgcggaacttggaatcgaagtcatggtcacggagcttgatattacggtccttccttcgccgagaagtgatgacccggatccgtatgccgacggactacccattgatgttgccgaagagcaggcacagcgctatcgggatttgttcgagatatatctcaaacacagcgatgtggttacccgtgttactttttggggccacatggatgagagtcactggctgaactacctgccaatcgagcgcgccaaccaccctgtgctttttgaccgggataaccaggccaagccggcttttcatgctgtttacgagctgggtgccggaagaaactga

SEQ ID NO: 446 - protein, 396 aa, Unknown
  Obtained from environmental sample
  DOMAIN (37)...(392): Glycosyl hydrolase family 10
  SITE (29)...(32): N-glycosylation site. Prosite id = PS00001
  SITE (296)...(306): Glycosyl hydrolases family 10 active site. Prosite id = PS00591
MKNIILNLSPVVFALLILTAACEPVQEENTSLSLDPPLYEVYEDAFLLGTILNRAQIYADGGEVPVEVVRQDRRGYFVERQVIPQPEGLKLGLHHFNQVTAENVMKWEEIHPEPGVYDFDAADRLVDLAEANGMHITGHALVWHNQTPDWVFEDDNGQPIDRDALLERMRDHIHTVVGRYAGRVHSWDVVNEAVSEDGGFRQTRWLEIIGDDFIVRAFEYAHEADPEARLYYNDYNMETNPVKRQGAIDIVRNVMDSGVPVHGIGTQSHLNLLSFPDLAEVEQAIIDFAELGIEVMVTELDITVLPSPRSDDPDPYADGLPIDVAEEQAQRYRDLFEIYLKHSDVVTRVTFWGHMDESHWLNYLPIERANHPVLFDRDNQAKPAFHAVYELGAGRN

SEQ ID NO: 447 - DNA, 1107 bp, Unknown
  Obtained from environmental sample
atgaatgcgctacgcacaggggcgatattggtattgatgctggcggcggcgcaggtcagcgccgcctgccggtggccggcctgggatcagttcaggaaagagtacgtcagcgccgaagggcgcgtcgttgaccccagcgatccgcgaaaaatcaccacttcggaagggcagagctacggcctgttctttgccctggcggctaacgatcgcgatgcgttcggcaagctgctgcagtggacgcaaaacaacctcgccgagggcgacctgcgcgcgcgcctgcccggctggctgtggggcaaaaagagcgacagcgagtggacgatgctggacagcaactcggcctccgattcggacctgtggatagcctggtcgctgctggaagccgggcgtctgtggcagatgccgcagtacgttgagacgggtaaagcgctgctgtcgcggattgcgcaagaagaggtggcggacgtgccggggctggggccgatggtgctgccggggaaggtcggctttgctgacgataaaggctggcgcttcaaccccagctatctcccgccgcagctggcgaactattttgtccgctacggcgccccgtggccgaagctgcgcgacggcaatatccgcctgctgctggagacggcgcccaagggcctctcccctgactgggtacgctacgagaaaggtaagggctgggagctgaaggcggataaaccgattatcggcagctacgacgcgatccgcgtctatttgtgggtcggcatgctcaacgacggcgataagcagaagacacgcctgctggctcattttaaaccgatggcgcagcagaccatcagccagggcctgccgccggaaaaggtgaatatcgccaccgcgaagaccgcaggaaatggcccggtaggcttctcggccgcgctgctgccgttcttgcaaaatgaggatgcccgggccgttcagcgccagcgcgtcagcgacaactatcccggcgcggacgcgtactatagcgcggtcctgaccctttttggccagggatgggatcaacatcgttttcgctttaccgccgatggcgaattacaacctgactggaaccaggaatgcgtaagttctcactaa

SEQ ID NO: 448 - protein, 368 aa, Unknown
  Obtained from environmental sample
  DOMAIN (1)...(346): Glycosyl hydrolases family 8
MNALRTGAILVLMLAAAQVSAACRWPAWDQFRKEYVSAEGRVVDPSDPRKITTSEGQSYGLFFALAANDRDAFGKLLQWTQNNLAEGDLRARLPGWLWGKKSDSEWTMLDSNSASDSDLWIAWSLLEAGRLWQMPQYVETGKALLSRIAQEEVADVPGLGPMVLPGKVGFADDKGWRFNPSYLPPQLANYFVRYGAPWPKLRDGNIRLLLETAPKGLSPDWVRYEKGKGWELKADKPIIGSYDAIRVYLWVGMLNDGDKQKTRLLAHFKPMAQQTISQGLPPEKVNIATAKTAGNGPVGFSAALLPFLQNEDARAVQRQRVSDNYPGADAYYSAVLTLFGQGWDQHRFRFTADGELQPDWNQECVSSH

SEQ ID NO: 449 - DNA, 1107 bp, Unknown
  Obtained from environmental sample
gtgatgaaagcctttcgctggtgtgtcattgcgttgatgctggcggcggcgcctctgcgcgccgcctgtacatggcctgcctgggagaaatttaaacaggattacatcagcgagggcgggcgggtcattgatcccagcgacacgcgtaaaatcactacctcggaagggcaaagctacgcgctgttctttgccctcgccgcgaatgaccgtaaagcgttcgacaaggtgctggcatggacgcgggataaccttgccggggggcatctcgacgacacgctccccgcctggttatgggggcaaaaagacaaagacacctgggcggttatcgataccaattccgcctcggatgccgatatctggatcgcctggtccctgcttgaagcggggcggttatggaaagacgctgactatacccgtacgggcaagacgctactcgagcgcatcgcccgcgaagaagtggtgaaagtacctggcctcggtctgatgctgctgcccggtaaagttggctttgtcgatgagaacgcctggcgttttaatcccagctatcttcctccacagctcgcaagctacttcacgcgttttggcgccccgtggaccaccctgcgtgagaccaatctgcgcttgctgctggagagtgcgccgaaaggtttttcgccggactgggtgcaataccagaaaaacaaaggctggcggttacaacaggagccgccgctggtggggggatatgacgccatccgcgtctatctctgggtggggatgatgaacgataacgatcctcagaaagcccggctgctggcgcgcttcaggccgatggccgccaccacaacaaaacagggcgtaccaccggagaaagtgaatgtggcgagtggagcacgcacgggcaatggcccggtcggcttctctgccgccatgctgccttttttacaacagcgtgatgcgcaggccgtccagcgccagcgcgtggctgaccactttcctgataataatgcttactacagttatgtactgactctctttggacaaggatgggatcagcatcgttttcgtttcaccacaaaaggtgaattaataccggattggggccaggaatgcgcaagttcacagtaa

SEQ ID NO: 450 - protein, 368 aa, Unknown
  Obtained from environmental sample
  SIGNAL (1)...(22)
  DOMAIN (1)...(346): Glycosyl hydrolases family 8
MMKAFRWCVIALMLAAAPLRAACTWPAWEKFKQDYISEGGRVIDPSDTRKITTSEGQSYALFFALAANDRKAFDKVLAWTRDNLAGGHLDDTLPAWLWGQKDKDTWAVIDTNSASDADIWIAWSLLEAGRLWKDADYTRTGKTLLERIAREEVVKVPGLGLMLLPGKVGFVDENAWRFNPSYLPPQLASYFTRFGAPWTTLRETNLRLLLESAPKGFSPDWVQYQKNKGWRLQQEPPLVGGYDAIRVYLWVGMMNDNDPQKARLLARFRPMAATTTKQGVPPEKVNVASGARTGNGPVGFSAAMLPFLQQRDAQAVQRQRVADHFPDNNAYYSYVLTLFGQGWDQHRFRFTTKGELIPDWGQECASSQ

SEQ ID NO: 451 - DNA, 681 bp, Unknown
  Obtained from environmental sample
ttgttatttgaacggttgaaagcacatatttcaactgttgtacagcgatataaggggaaagtgtactgttgggatgtcgttaatgaagctgttgcggatgaagataacgatttattgcgtatttctagatggagtgaagtagctggcatggaattcatcgagaaggcatttctttatgcccgtgaagctgatcctaatgcccttttattttacaacgattataatgaatcatttccagagaaaagggagaagatttacaagttagtgaagtcactacttgaaaaacacataccagtcgatggtatagggatgcaagcacattggagtttgactcgtccaacattagaagagattcgtatagctattgaacgatatgcctcacttggcgtccaactacatattacagagttggacatatccatgttcgagtttgacgaccatcgaaatgatttaataaagccgacagatcaaatgattgataagcaagcagagcggtatgaacaaattttttctttatttaaggagtatagtgatgtcattcaaaatgtaacattttggggcattgcagacgattatacgtggcttgataattttccagtggagaatagaaaaaattggccgtttttgtttgatgaaaatcatcagccgaagccagctttttggaaagtctgtacatgttaa

SEQ ID NO: 452 - protein, 226 aa, Unknown
  Obtained from environmental sample
  DOMAIN (1)...(225): Glycosyl hydrolase family 10
  SITE (76)...(79): N-glycosylation site. Prosite id = PS00001
  SITE (184)...(187): N-glycosylation site. Prosite id = PS00001
MLFERLKAHISTVVQRYKGKVYCWDVVNEAVADEDNDLLRISRWSEVAGMEFIEKAFLYAREADPNALLFYNDYNESFPEKREKIYKLVKSLLEKHIPVDGIGMQAHWSLTRPTLEEIRIAIERYASLGVQLHITELDISMFEFDDHRNDLIKPTDQMIDKQAERYEQIFSLFKEYSDVIQNVTFWGIADDYTWLDNFPVENRKNWPFLFDENHQPKPAFWKVCTC

SEQ ID NO: 453 - DNA, 1002 bp, Cochliobolus heterostrophus ATCC 48333
ggccctgttcgtcctggccccagtgatagcctttacaaggccatggagaaggccggaagggacttcattggcactgccctgaccctcaggaactctacccgcgaggacgagattatggatgccgacttcaactccttcacgcctgagaacagcatgaagtgggagtcgaccgagccatctcgtaacaacttcacctttgcggatgccgaccgctatgccgcatacgccaagaagaacgagttcgaggtccactgccacacgcttgtctggcactcccagctccctgcctgggtctccaacggcggtttcgacaacaagacgctgattgacatcatggagaaccacatcaagaccgtcatgacgcgctacaagagcgtctgcacccgctgggacgttgtcaacgaggccctcaacgaagacggcacctaccgcgagtccgtgtggtacaacaccatcggcgaggccttcctgcccattgccttccgcttcgccaaccagtaccgcggcaaggcccaactctactacaacgactacaacctcgagtacaacggcaacaagacccagggtgctgcccgtatcgtcaagctcatcaagtcctacggcatccgcattgatggcgtcggctaccaggcccatctcgccagcgagcccacccccaccgcccccggcgctgcccccgaccaggccactctcgaggctgccctccgcgccaccgccaacctcggcgtcaaggtcgcctacaccgagatcgatctccgcatgaacacccctgccacccccgagaagctccaggtccaggccgatgctttcgagcgcgttgccaggtcctgccttgctgtcaagcagtgcactggtatgactgtctggggtatttctgacctgtactcgtggatccctggcgttttcgctggtgagggcgctgccctgctctgggatgagtcctacaacaagaagcctgcctatgctggtttcttgaagggaatcaaggccaagaagcactag

SEQ ID NO: 454 - protein, 333 aa, Cochliobolus heterostrophus ATCC 48333
  DOMAIN (10)...(328): Glycosyl hydrolase family 10
  SITE (31)...(34): N-glycosylation site. Prosite id = PS00001
  SITE (63)...(66): N-glycosylation site. Prosite id = PS00001
  SITE (106)...(109): N-glycosylation site. Prosite id = PS00001
  SITE (187)...(190): N-glycosylation site. Prosite id = PS00001
GPVRPGPSDSLYKAMEKAGRDFIGTALTLRNSTREDEIMDADFNSFTPENSMKWESTEPSRNNFTFADADRYAAYAKKNEFEVHCHTLVWHSQLPAWVSNGGFDNKTLIDIMENHIKTVMTRYKSVCTRWDVVNEALNEDGTYRESVWYNTIGEAFLPIAFRFANQYRGKAQLYYNDYNLEYNGNKTQGAARIVKLIKSYGIRIDGVGYQAHLASEPTPTAPGAAPDQATLEAALRATANLGVKVAYTEIDLRMNTPATPEKLQVQADAFERVARSCLAVKQCTGMTVWGISDLYSWIPGVFAGEGAALLWDESYNKKPAYAGFLKGIKAKKH

SEQ ID NO: 455 - DNA, 2823 bp, Unknown
  misc_feature: Bacterial DNA
gtggccggagaatggactgagatttcggcaaaatacaaagcacccaaaactgcagtgaatattactttgtcaattacaaccgacagcactgtagatttcatttttgacgatgtaaccataacccgtaaaggaatggctgaggcaaacacagtatatgcagcaaacgctgtgctgaaagatatgtatgcaaactatttcagagttggttcggtacttaactccggaacggtaaacaattcatcaataaaggccttgattttaagagagtttaacagtattacctgtgaaaatgaaatgaagcctgatgccacactggttcaatcaggatcaaccaatacaaatatcagggtttctcttaatcgtgcagcaagtattttaaacttctgtgcacaaaataatatagccgtcagaggtcatacactggtttggcacagccagacacctcaatggtttttcaaagacaatttccaggacaacggaaactgggtttcccaatcagttatggaccagcgtttggaaagctacataaaaaatatgtttgctgaaatccaaagacagtatccgtctttgaatctttatgcctatgacgttgtaaatgaggcagtaagtgatgatgcaaacaggaccagatattatggcggggcgagggaacctggatacggaaatggtagatctccatgggttcagatctacggagacaacaaatttattgagaaagcatttacatatgcaagaaaatatgctccggcaaattgtaagctttactacaacgattacaacgaatattgggatcataagagagactgtattgcctcaatttgtgcaaacttgtacaacaagggcttgcttgacggtgtgggaatgcagtcccatattaatgcggatatgaatggattctcaggtatacaaaattataaagcagctttgcagaaatatataaatatcggttgtgatgtccaaattaccgagcttgatattagtacagaaaacggcaaatttagcttacagcagcaggctgataaatataaagctgttttccaggcagctgttgatataaacagaacctccagcaaaggaaaggttacggctgtctgtgtatggggacctaatgacgccaatacttggctcggttcacaaaatgcacctcttttgtttaacgcaaacaatcaaccgaaaccggcatacaatgcggttgcatccattattcctcagtccgaatggggcgacggtaacaatccggccggcggcggaggaggaggcaaaccggaagagccggatgcaaacggatattattatcatgacacttttgaaggaagcgtaggacagtggacagccagaggacctgcggaagttctgcttagcggaagaacggcttacaaaggttcagaatcactcttggtaaggaaccgtacggcagcatggaacggagcacaacgggcgctgaatcccagaacgtttgttcccggaaacacatattgtttcagcgtagtggcatcgtttattgaaggtgcgtcttccacaacattctgcatgaagctgcaatacgtagacggaagcggcactcaacggtatgataccatagatatgaaaactgtgggtccaaatcagtgggttcacctgtacaatccgcaatacagaattccttccgatgcaacagatatgtatgtttatgtggaaacagcggatgacaccattaacttctacatagatgaggcaatcggagcggttgccggaactgtaatcgaaggacctgctccacagcctacacagcctccggtactgcttggcgatgtaaacggtgatggaaccattaactcaactgacttgacaatgttaaagagaagcgtgttgagggcaatcacccttaccgacgatgcaaaggctagagcagacgttgacaagaatggatcgataaacagcactgatgttttacttctttcacgctaccttttaagagtaatcgacaaatttcctgtagcagaaaatccttcttcttcttttaaatatgagtcggccgtgcaatatcggccggctcctgattcttatttaaacccttgtccgcaggcgggaagaattgtcaaggaaacatatacaggaataaacggaactaagagtcttaatgtatatcttccatacggttatgatccgaacaaaaaatataacattttctaccttatgcatggcggcggtgaaaatgagaatacgattttcagcaacgatgttaaattgcaaaatatccttgaccacgcgattatgaacggtgaacttgagcctttgattgtagtaacacccactttcaacggcggaaactgcacggcccaaaacttttatcaggaattcaggcaaaatgtcattccttttgtggaaagcaagtactctacttatgcagaatcaacaaccccacagggaatagccgcttcaagaatgcacagaggtttcggcggattctcaatgggaggattgacaacatggtatgtaatggttaactgccttgattacgttgcatattttatgcctttaagcggtgactactggtatggaaacagtccgcaggataaggctaattcaattgctgaagcaattaacagatccggactttcaaagagggagtatttcgtatttgcggccaccggttccgaggatattgcatatgctaatatgaatcctcaaattgaagctatgaaggctttgccgcattttgattatacttcggatttttccaaaggtaatttttactttcttgtagctccgggcgccactcactggtggggatacgtaagacattatatttatgatgcacttccatatttcttccatgaatga

SEQ ID NO: 456 - protein, 940 aa, Unknown
  DOMAIN (1)...(940): Bacterial protein
  DOMAIN (57)...(402): Glycosyl hydrolase family 10
  DOMAIN (428)...(577): Carbohydrate binding domain
  DOMAIN (597)...(617): Dockerin type I repeat
  DOMAIN (631)...(651): Dockerin type I repeat
  SITE (20)...(23): N-glycosylation site. Prosite id = PS00001
  SITE (79)...(82): N-glycosylation site. Prosite id = PS00001
  SITE (210)...(213): N-glycosylation site. Prosite id = PS00001
  SITE (358)...(361): N-glycosylation site. Prosite id = PS00001
  SITE (476)...(479): N-glycosylation site. Prosite id = PS00001
  SITE (606)...(618): EF-hand calcium-binding domain. Prosite id = PS00018
  SITE (606)...(625): Clostridium cellulosome enzymes repeated domain signature. Prosite id = PS00448
  SITE (614)...(617): N-glycosylation site. Prosite id = PS00001
  SITE (640)...(659): Clostridium cellulosome enzymes repeated domain signature. Prosite id = PS00448
  SITE (640)...(652): EF-hand calcium-binding domain. Prosite id = PS00018
  SITE (644)...(647): N-glycosylation site. Prosite id = PS00001
  SITE (648)...(651): N-glycosylation site. Prosite id = PS00001
  SITE (711)...(714): N-glycosylation site. Prosite id = PS00001
  SITE (781)...(784): N-glycosylation site. Prosite id = PS00001
  SITE (875)...(878): N-glycosylation site. Prosite id = PS00001
MAGEWTEISAKYKAPKTAVNITLSITTDSTVDFIFDDVTITRKGMAEANTVYAANAVLKDMYANYFRVGSVLNSGTVNNSSIKALILREFNSITCENEMKPDATLVQSGSTNTNIRVSLNRAASILNFCAQNNIAVRGHTLVWHSQTPQWFFKDNFQDNGNWVSQSVMDQRLESYIKNMFAEIQRQYPSLNLYAYDVVNEAVSDDANRTRYYGGAREPGYGNGRSPWVQIYGDNKFIEKAFTYARKYAPANCKLYYNDYNEYWDHKRDCIASICANLYNKGLLDGVGMQSHINADMNGFSGIQNYKAALQKYINIGCDVQITELDISTENGKFSLQQQADKYKAVFQAAVDINRTSSKGKVTAVCVWGPNDANTWLGSQNAPLLFNANNQPKPAYNAVASIIPQSEWGDGNNPAGGGGGGKPEEPDANGYYYHDTFEGSVGQWTARGPAEVLLSGRTAYKGSESLLVRNRTAAWNGAQRALNPRTFVPGNTYCFSVVASFIEGASSTTFCMKLQYVDGSGTQRYDTIDMKTVGPNQWVHLYNPQYRIPSDATDMYVYVETADDTINFYIDEAIGAVAGTVIEGPAPQPTQPPVLLGDVNGDGTINSTDLTMLKRSVLRAITLTDDAKARADVDKNGSINSTDVLLLSRYLLRVIDKFPVAENPSSSFKYESAVQYRPAPDSYLNPCPQAGRIVKETYTGINGTKSLNVYLPYGYDPNKKYNIFYLMHGGGENENTIFSNDVKLQNILDHAIMNGELEPLIVVTPTFNGGNCTAQNFYQEFRQNVIPFVESKYSTYAESTTPQGIAASRMHRGFGGFSMGGLTTWYVMVNCLDYVAYFMPLSGDYWYGNSPQDKANSIAEAINRSGLSKREYFVFAATGSEDIAYANMNPQIEAMKALPHFDYTSDFSKGNFYFLVAPGATHWWGYVRHYIYDALPYFFHE

SEQ ID NO: 457 - DNA, 984 bp, Unknown
  Obtained from environmental sample
gtgattgacccgagcgacgcgcgcaaaatcaccacctccgaagggcaaagctacgccttgttcttcgcgctggcggcgaacgatcgtgaagccttcgcttcgctgtttgactggacgcaaaacaacctggcggaaggggatttaaaagcccatcttcccgcctggctgtggggtaaaaaggcggacgacagctggaccgtgctcgacggtaactccgcgtcagatgccgatatctggatagcctggtcgctgctcgaagccgggcggctgtggaaaatgccgcagtacagcgaaaccggtaaagccctgctgtctcgcatcgccaaagaggaagtggtgaaagtgcccggtctgggctctatgctgctaccgggtaaagtgggctttgttgatgacgccggctggcgctttaacccaagctatttgcctccgcagattgcggcttacttcgcgcgttttggcgagccgtggagcgcgattcaggccaccaaccttcgcctgctgcaggaaacggcacctaaaggctactcgcctaactgggtacgttttgacaacaaaaaaggctggcagctaaagcaggataaatcgctgctcggcagctacgacgcgatccgcgtgtatctttgggtcggcatgctcaacgacgccgatccgcagaaaccgcggctgctgaaaaagttcaggccaatggcgatgcaaaccgccaaagcgggcgcggtgccggagaaaatcgatattgccaccgggaaggtggagggcgatggcccggtcggtttttctgcctcgctgctgccgtttttacaggaccgggacgctcaggccgttcagcgccagcgcgtcgccgaccgtttccccggcaatgacgcctattacagctatgttttgaccctgttcggacaaggatgggatcagcatcgttttcgcttcaccgctcgcggtgaacttctacctgactggggccaggaatgcgtaagttctcactaa

SEQ ID NO: 458 - protein, 327 aa, Unknown
  Obtained from environmental sample
  DOMAIN (1)...(305): Glycosyl hydrolases family 8
  SITE (74)...(92): Glycosyl hydrolases family 8 signature. Prosite id = PS00812
MIDPSDARKITTSEGQSYALFFALAANDREAFASLFDWTQNNLAEGDLKAHLPAWLWGKKADDSWTVLDGNSASDADIWIAWSLLEAGRLWKMPQYSETGKALLSRIAKEEVVKVPGLGSMLLPGKVGFVDDAGWRFNPSYLPPQIAAYFARFGEPWSAIQATNLRLLQETAPKGYSPNWVRFDNKKGWQLKQDKSLLGSYDAIRVYLWVGMLNDADPQKPRLLKKFRPMAMQTAKAGAVPEKIDIATGKVEGDGPVGFSASLLPFLQDRDAQAVQRQRVADRFPGNDAYYSYVLTLFGQGWDQHRFRFTARGELLPDWGQECVSSH

SEQ ID NO: 459 - DNA, 1524 bp, Cochliobolus heterostrophus ATCC 48333
ttgcccccttatgcccagtgcggcggcgtcacctacaaaggtgacagtgcctgcgcttctggctggcactgcgtcaagtacaacgactggtacagccagtgtgtccctggcggagaagcttctcctccacctgccaacagtccttctgctgctcccagcttgcccagcaaagccccggctatggagcctaacagtaccgtacctgtggctacccctgcttcctcgcctgtcgacgacgagtcctgcgatgctgatgaggagggtggtgatgctaacacggatgcaaatgaaggggatgacgagtcctgcgacgccgatgaggagggtggcgatgctggcacccagggaagtgagggtgatgatgagtcttgtgaggctgatgacgaacccgttccatcgccatctccagctgctagctccggtggcaacactggtgttacgcccgctgcttctccttctccttccccagctgcctccccttcttcgactgctacctccgcaagcctgtctagtgttgaacctactacttctccttccccctctccagctgctggctctggcggaaacagtcccgctcccaatgttgccggcagcggccgcaatggcgccaaatgcgatcttgatgctgccttcaaggccaagggcaagaaatacgttggtgttgccactgatcaataccgtctcagcactggcaagaacaaggagatcattgtcgacaactttggctgtgttactcctgagaacagcatgaagtgggatgccactgagcccagcgagggccaattcactctcgatggcgctaatgctctcgtttctttcgccaccagtaacggcaaactcatccgcggtcacactaccgtatggcactctcagttggctgcatgggtttctcagatccgtgacaaggccaagctcgaagaggtcatggttaaccacataaagaagctcgttggtacctatgctggcaagatctacgcctgggatgttgtgaacgaaatccttgacgagcaaggtggcttccgatccagtgtcttctacaacgtccttggtgaaggcttcgtctccaccgctttccacgctgcccgtcaggccgatcccctcgctaagctctacatcaacgactacaaccttgacggcgcaaactacgccaagacaaagggcatgattagccatgtagagaagtggattgccgacggtgttcccattgacggaatcggctcccaatcccacatcagctcccccggcactcttttccccatctctggtgtccctgctgctttgaaagctctctgcggtgccgcccccgagtgtgccataactgagttggatatcaactacggtaagcccgccgattgggtcaccgtcttcgatggttgtctcgatatcaaaaactgtgtcggtatcactgtttggggtgtttctgacaaagactcttggatcggtgctgccggtggacctctcctgttcgacagctccttccaggctaaaccctcttacaatgagctttgctctgctcttgcttga

SEQ ID NO: 460 - protein, 507 aa, Cochliobolus heterostrophus ATCC 48333
  DOMAIN (3)...(31): Fungal cellulose binding domain
  DOMAIN (206)...(506): Glycosyl hydrolase family 10
  SITE (7)...(34): Cellulose-binding domain, fungal type. Prosite id = PS00562
MPPYAQCGGVTYKGDSACASGWHCVKYNDWYSQCVPGGEASPPPANSPSAAPSLPSKAPAMEPNSTVPVATPASSPVDDESCDADEEGGDANTDANEGDDESCDADEEGGDAGTQGSEGDDESCEADDEPVPSPSPAASSGGNTGVTPAASPSPSPAASPSSTATSASLSSVEPTTSPSPSPAAGSGGNSPAPNVAGSGRNGAKCDLDAAFKAKGKKYVGVATDQYRLSTGKNKEIIVDNFGCVTPENSMKWDATEPSEGQFTLDGANALVSFATSNGKLIRGHTTVWHSQLAAWVSQIRDKAKLEEVMVNHIKKLVGTYAGKIYAWDVVNEILDEQGGFRSSVFYNVLGEGFVSTAFHAARQADPLAKLYINDYNLDGANYAKTKGMISHVEKWIADGVPIDGIGSQSHISSPGTLFPISGVPAALKALCGAAPECAITELDINYGKPADWVTVFDGCLDIKNCVGITVWGVSDKDSWIGAAGGPLLFDSSFQAKPSYNELCSALA

SEQ ID NO: 461 - DNA, 990 bp, Unknown
  Obtained from environmental sample
atgtggcagcgaagtaaaaccctggttctggtgctgggactgttgttaagtcatcaggcctttgccggccccgcctgggacagctacaaagcgcgatttttgatggcggatggtcgcatcattgataccggcaacaacagtgtgagccacactgaggggcagggcttcgccatgatgatggcggtgcgtaacaacgatcgcgccggttttgacaaaatctggaactggacgaaaaagaacctgcagaatcccgagaccggactgttctactggcgttataacccggtggcaccggacccgattgccgacagaaacaatgccaccgacggcgatacctttatcgcctgggcgctgttaaaagcgggtacccagtggaatgacaacagctatctgaacgcctcggacgccatcactaaatcgctgctggcccgcaacgtaatcagctttgccggttaccgcgtgatgctgcctggcgcgaagggctttaacctcaacagctacgtgaaccttaatccgtcctatttcatcttccctgcgtgggaggatttcgcgaagcgcagtcatctgacggtgtggcgtgacctgatcaatgacggacagaagctgctggtgaagatgcgcttcggcaatacccagcttcctgcagactgggtttccctgtacgccgacggtcgcgtgaccccggccaaagagtggccggcgcgctttagctacgatgcgatccgcgtcccgctgtatatcaagtgggcgaatgcttccagcccgctgatggccccttacaccgcgtactggggacggtttgcccgtacccagacgccagcctgggtgaatgtcaccaccggcgatccggcgccgtatatgatggcgggtgggttgctggcggtgcgtgatttggcgctggggcaacttccggcgggcgatccgcagatcacgacgcaggaggattactattctgcgagtctgaagatgctggtgtcgttagcgaaataa

SEQ ID NO: 462 - protein, 329 aa, Unknown
  Obtained from environmental sample
  SIGNAL (1)...(22)
  DOMAIN (1)...(329): Glycosyl hydrolases family 8
  SITE (45)...(48): N-glycosylation site. Prosite id = PS00001
  SITE (76)...(79): N-glycosylation site. Prosite id = PS00001
  SITE (107)...(110): N-glycosylation site. Prosite id = PS00001
  SITE (108)...(126): Glycosyl hydrolases family 8 signature. Prosite id = PS00812
  SITE (134)...(137): N-glycosylation site. Prosite id = PS00001
  SITE (254)...(257): N-glycosylation site. Prosite id = PS00001
  SITE (281)...(284): N-glycosylation site. Prosite id = PS00001
MWQRSKTLVLVLGLLLSHQAFAGPAWDSYKARFLMADGRIIDTGNNSVSHTEGQGFAMMMAVRNNDRAGFDKIWNWTKKNLQNPETGLFYWRYNPVAPDPIADRNNATDGDTFIAWALLKAGTQWNDNSYLNASDAITKSLLARNVISFAGYRVMLPGAKGFNLNSYVNLNPSYFIFPAWEDFAKRSHLTVWRDLINDGQKLLVKMRFGNTQLPADWVSLYADGRVTPAKEWPARFSYDAIRVPLYIKWANASSPLMAPYTAYWGRFARTQTPAWVNVTTGDPAPYMMAGGLLAVRDLALGQLPAGDPQITTQEDYYSASLKMLVSLAK

SEQ ID NO: 463 - DNA, 1023 bp, Unknown
  Obtained from environmental sample
atgaatccaacattcagttccgtaccggcattaaaggagctgtttgcggcggacttcaacatcggggcggcggtgaatccgacgacgatccggacgcaggaggcgttgctggcttatcattttaacagcctgactgcggagaacgagatgaagttcgtcagcgtgcatccggaggagcagacctataccttcgaggcggcggaccggctggtcgaattcgcccgagagcacggcatggccatgcggggacacacgctcgtatggcataaccagacgtccgattggctgttccaggatcgccaaggcgggagggtaagcaaggaggtgctgctcggaaggctccgggagcatattcataccatagtaggccggtacaagaacgagatctacgcctgggacgtcgtcaacgaggtcatcgcggacgaaggggaggcgctgctgcgcacttccaaatggacggaaatcgcgggacctgaatttatcgctaaagcgttcgagtatgcacatgaggcggatccacaggcgctgttgttttataacgactacaacgaatcgaatcctctgaaacgcgataaaatttacacactcgttcattcgctgctggagcaaggggtgccgatccatggcatcggattacaagcgcactggaacctgtacgatccatcgttggatgagattaaggcagcgattgagaagtatgcttcgctgggtttgcagctgcagctgacggagctggatctctcgatgttccgcttcgatgaccggcgaaccgatttgaccgcgccagagccggggatgctggagcaacaggccgagcgttatgaagccgtgttccggctgttgctggagtatcgtgacgtcatcagcggcgttaccttctggggagcggcggatgattatacctggctggacaattttccggtgcgcggccggaagaactggccgtttctgttcgatgcccagcaccagccgaaggcagcttatcaccgtgtggcggcattggctgcggagcaacgagcataa

SEQ ID NO: 464 - protein, 340 aa, Unknown
  Obtained from environmental sample
  DOMAIN (10)...(335): Glycosyl hydrolase family 10
  SITE (91)...(94): N-glycosylation site. Prosite id = PS00001
  SITE (185)...(188): N-glycosylation site. Prosite id = PS00001
MNPTFSSVPALKELFAADFNIGAAVNPTTIRTQEALLAYHFNSLTAENEMKFVSVHPEEQTYTFEAADRLVEFAREHGMAMRGHTLVWHNQTSDWLFQDRQGGRVSKEVLLGRLREHIHTIVGRYKNEIYAWDVVNEVIADEGEALLRTSKWTEIAGPEFIAKAFEYAHEADPQALLFYNDYNESNPLKRDKIYTLVHSLLEQGVPIHGIGLQAHWNLYDPSLDEIKAAIEKYASLGLQLQLTELDLSMFRFDDRRTDLTAPEPGMLEQQAERYEAVFRLLLEYRDVISGVTFWGAADDYTWLDNFPVRGRKNWPFLFDAQHQPKAAYHRVAALAAEQRA

SEQ ID NO: 465 - DNA, 2142 bp, Unknown
  Obtained from environmental sample
gtggacgatttcaaaataacggataccacaactactgacatcaagctcgagctgaagcctgaagaagaaattccagctcttaaagaagtgcttggagattacttcaaagtaggtgttgccttacctttcaaagtttttgccaaaccagaggatattgctctcattactaaacatttcaacagcatcactgccgaaaacgaaatgaaacctgagagtctcttggctggcgtagaaaatggaaagttgaagttcaggtttgagacagcagacaaatacgtagaatttgcacagcaaaacggtatggttgtgagaggtcacactctggtgtggcacaatcaaacaccggactggttcttcaaggacgagaacggaaatctgctctccaaagaagcaatgactgaaaggcttagggaatacatccacacagtcgtcggacacttcaaaggcaaagtttacgcgtgggacgtcgttaatgaggcagtagatccatcccaaccagatggacttagaagatctatatggtacgaaatcatgggacctgactatatagaacttgcattcaagtttgcaagagaagcggaccccaatgcaaagctcttctacaacgactacaacacctaccaggagaagaagagagacatcatttacaacctcgtcaaatccctcaaagagaagggactcattgacggtatcggtatgcagtgtcatatcggtgttgggaccagtgtcaaagagattgaagaggcaatcaaaaaattcagcaccattccaggtatcgaaattcatatcacggaactagatataagtgtgtacgaggatgcgacttccaattatccaacacctccaagggaggctctcattaaacaagcacacgtaatgagagaactctttgccatcttcaaaaagtacagcaacgtcataacaaacgttactttctggggattgaaagatgattattcctggaagaatgcccgcagaaacgactggccgctactttttgataaagactaccaagccaaacttgcctactgggccatagtcagtcctgaggctctaccggtgcttccaaagaaatggtctatcgctacaggtagtgctttggtagttggaatgatggatgactcctatttggcttcttcacctatcaaaattctcgtcgatggccaagaaaaactcacagccagagtcatctgggaagaaaacaaactcttcgtctacgcagaggtctatgacaggacaagagacaaaggaaaggacggtatcaccatctttgtggatcctaaaaacttcaaggcaccttacttgcatgaagatgctttctacgttaccataaaaaccgactggagtgttgagaagagtcgtgatgacatagaagtccagagattcgtaggtccaagtggagtaaggtacaacgttgaatgtgaaataacacttcctgaaaaactccaggaaggacagcaaatcggatttgatatcgccgtccaggatggcgataaggtctacagctggtctgatacatccaatcagcagaagctcgcaaccatgaactacggaactctcactctgcagggtgcggtaatggccacagctaagtatggcacacctgtgatcgatggtgaaatagatgacatctggtacaccactgaagaaatctcaaccgatgttgttgtcatgggttcactcaagaacgcaagggcaaaagtgagagtgctctgggatgaagagcacctctatgtgcttgccatcgtaaccgatcctgtgctcaataaggacaacaccaatccatgggaacaagactctgtagaaatcttcatagacgaaaacaacgccaaaacaccgtactatcaggacgatgatgctcaatatcgtgtcaactacctcaacgaacaatccttcggtacaggtgcaagcagcaagaacttcaagacagccgtgaaactcatcgatggtggttatcttgttgaggcagcggttaaatggaagaccatcaaaccttcaccaaacacagtgataggctttgatttccaggtgaacgatgcaaatgctcaaggtaagagagttggaatacttaagtggtgcgatccaacggacaacagctggcagaatacctccaagtttggtaatctcaggttgataaaatag

SEQ ID NO: 466 - protein, 713 aa, Unknown
  Obtained from environmental sample
  DOMAIN (26)...(350): Glycosyl hydrolase family 10
  DOMAIN (532)...(713): Domain of unknown function (DUF1083)
  SITE (313)...(316): N-glycosylation site. Prosite id = PS00001
  SITE (712)...(715): N-glycosylation site. Prosite id = PS00001
MDDFKITDTTTTDIKLELKPEEEIPALKEVLGDYFKVGVALPFKVFAKPEDIALITKHFNSITAENEMKPESLLAGVENGKLKFRFETADKYVEFAQQNGMVVRGHTLVWHNQTPDWFFKDENGNLLSKEAMTERLREYIHTVVGHFKGKVYAWDVVNEAVDPSQPDGLRRSIWYEIMGPDYIELAFKFAREADPNAKLFYNDYNTYQEKKRDIIYNLVKSLKEKGLIDGIGMQCHIGVGTSVKEIEEAIKKFSTIPGIEIHITELDISVYEDATSNYPTPPREALIKQAHVMRELFAIFKKYSNVITNVTFWGLKDDYSWKNARRNDWPLLFDKDYQAKLAYWAIVSPEALPVLPKKWSIATGSALVVGMMDDSYLASSPIKILVDGQEKLTARVIWEENKLFVYAEVYDRTRDKGKDGITIFVDPKNFKAPYLHEDAFYVTIKTDWSVEKSRDDIEVQRFVGPSGVRYNVECEITLPEKLQEGQQIGFDIAVQDGDKVYSWSDTSNQQKLATMNYGTLTLQGAVMATAKYGTPVIDGEIDDIWYTTEEISTDVVVMGSLKNARAKVRVLWDEEHLYVLAIVTDPVLNKDNTNPWEQDSVEIFIDENNAKTPYYQDDDAQYRVNYLNEQSFGTGASSKNFKTAVKLIDGGYLVEAAVKWKTIKPSPNTVIGFDFQVNDANAQGKRVGILKWCDPTDNSWQNTSKFGNLRLIK

SEQ ID NO: 467 - DNA, 978 bp, Unknown
  misc_feature: Bacterial DNA
gtgaagttctttactgttcttttgtttttcctttcattcgttttttcggcgagtattgacgtgtggaaattgtgggaacattataaaaagacctttataagtaaagaggggtacgtggtagatccttacaacaattacagggttacttcggaagctcaaggctatacacttctcatatccgccctcataggggataaggaaaccttctacagggtatggaactggacaaaggaaaatctcaaaaggaaggataatttattctcctggctctggataaacggacacgtagttgacagaaacaacgcaacggacgccgacctgttcatagcttacgctctgctaatcgcttctcaaaagtggaaggattatacgctcctgagcgaggcaaagaggataaaggattccgtcaaggaactcgttgtgcccgtgtgcaacggaagaagggattacctttttatacccgcaaaggaaggttacattaaaaacaatatagtgagtttaaacgtagtctactacgtcccattcatcttcagaaagttctacgaatctttcggagaggacgtgtggaaaaacctctataggtacacctacgacatttatacgattaggaatatatcaacgcaccttacatacgacctattcaaaaaggaattgagaaaggggaattttatagacatagacggcatgcgtttcctgatatacgcttacgtggacgacaaaaggagtctcctttacatgaggaacgcagtagagggtattctgaagttttacagagaaaagggttacattcctttgaagtataattacgtaaccggtggagcaagcaagttaaaagctcccttttgtttttactacgtattcagtaagctccttccttccgataaaaacttagaaaaggagttcagaaatgggcttgagtacgacaagaagaattactactgttacgctctgcttcttattgctctcctacacgattag

SEQ ID NO: 468 - protein, 325 aa, Unknown
  DOMAIN (1)...(325): Bacterial protein
  SIGNAL (1)...(16)
  DOMAIN (1)...(324): Glycosyl hydrolases family 8
  SITE (75)...(78): N-glycosylation site. Prosite id = PS00001
  SITE (102)...(105): N-glycosylation site. Prosite id = PS00001
  SITE (103)...(121): Glycosyl hydrolases family 8 signature. Prosite id = PS00812
  SITE (207)...(210): N-glycosylation site. Prosite id = PS00001
MKFFTVLLFFLSFVFSASIDVWKLWEHYKKTFISKEGYVVDPYNNYRVTSEAQGYTLLISALIGDKETFYRVWNWTKENLKRKDNLFSWLWINGHVVDRNNATDADLFIAYALLIASQKWKDYTLLSEAKRIKDSVKELVVPVCNGRRDYLFIPAKEGYIKNNIVSLNVVYYVPFIFRKFYESFGEDVWKNLYRYTYDIYTIRNISTHLTYDLFKKELRKGNFIDIDGMRFLIYAYVDDKRSLLYMRNAVEGILKFYREKGYIPLKYNYVTGGASKLKAPFCFYYVFSKLLPSDKNLEKEFRNGLEYDKKNYYCYALLLIALLHD

SEQ ID NO: 469 - DNA, 1929 bp, Unknown
  Obtained from environmental sample
gtgaacgctagctgggaaaaggattggaagacggctgctaacgagcaaatcgagcagctccgcaagcgcaatgtggagatcgaggtcgtcgatctgaacggaaacccgctgcctggggctaccgttcgcgcggttcagcgcacgcatcagtttggcttcggcaccgccatcaaccgaacggcgttgagcaatccggtgtacgccgattttgtcaaaaaccgtttcgaatgggtgaccttcgagaacgaggccaagtggctctggaatgaggccgtacaagggcgggtctattatcgggaggccgatcagctgctcgaatttgccaggcaaaacgggctgaaggtgcgcggacataatctgttctgggaggcggagaaatatcagccgcagtgggtgaagagtctgacgggcgctgcgctgaaggaagcgatcgataaccggctgaacagcgccgtcctgcattttaagggcaattttctgcactgggacgtcaacaacgaaatgtttcacggcagcttcttcaaggatcgcctgggggaagaaatctggacctatatgtataagcgaacccgggaactcgatcccggcgtcaagctgttcgtcaacgattacaattttatcgagtacccgccggagcgggattataaccaggtcattcaagcgctcatcgatcgggggatgccgattgacggcatcggcgcgcaagggcattttaacggagtcatcgatcccttgttcgttaagggaagactggataagctggctgagctgaatctgccgatctggattaccgaattcgattccacgcataaggacgagagagtccgtgccgataatctggagaagatgtatcggctggcgttcgcccatccggcggtcgaagggattgtcatgtggggcttctgggcgggctcccattggaagggcactgacggcgcgatcgtgaatcaagactggacgctcaatgccgccggacagcgataccagcagcttatggatgaatggacgacggtcgtcgaaggcacgaccgatcagcgcggcatgttttcgttccgggggttccacggaacctacgatatgctggtcgattaccctggagcggcggctgtgaagcagtcctttaccttggagcccggctctggcaatgcgaagctgcacattccgttcgacgttcaggacaagtccatcccggaggctcctgccaagctcagcgccgctgccgcggattcccaggttatgctgagctggagcaaggtcaacggggcaaccggctatacggttaaaagcgcggtcagcgccgacggtccctatacgccgattgcccatcagctgctcaccgagaccttcacgcacatcggtctagtgaaccggaaagattattattacgtggtgagcgccagcaaccatctaggtgagagcccggattccgccccgatccgggccactccgcgtgccgcgggcgagttacaaacgaatctcgtgcttcagtaccgctccgctgatggagataacaactatcaaatgaagcctcagttcacgatcaagaacgcaggcaaagtgcccatcccgttaagcgagctgacgatccgctactatttcacgccggagagcacgcagccggtggataccaggatcgactgggcccaattcggagcagagcatgtccagacgacggtcgttccgccatccgatgccgcggcgcacgcctatgtcgagctcagcttcctggagtcggcaggggccatcccttccgatacgacattaggcaatattcagctgcgcatctttaacagcgatggctcttcgttcgataaaacgaacgattattccttcgacccgacgaaaaaggcttatacggcgtgggagaaggtcacgctttatcggaacggggaactggtttgggggatagagccttggggcgcgaagtaa

SEQ ID NO: 470 - protein, 642 aa, Unknown
  Obtained from environmental sample
  DOMAIN (41)...(332): Glycosyl hydrolase family 10
  DOMAIN (495)...(574): Cellulose binding domain
  SITE (2)...(5): N-glycosylation site. Prosite id = PS00001
  SITE (58)...(61): N-glycosylation site. Prosite id = PS00001
MNASWEKDWKTAANEQIEQLRKRNVEIEVVDLNGNPLPGATVRAVQRTHQFGFGTAINRTALSNPVYADFVKNRFEWVTFENEAKWLWNEAVQGRVYYREADQLLEFARQNGLKVRGHNLFWEAEKYQPQWVKSLTGAALKEAIDNRLNSAVLHFKGNFLHWDVNNEMFHGSFFKDRLGEEIWTYMYKRTRELDPGVKLFVNDYNFIEYPPERDYNQVIQALIDRGMPIDGIGAQGHFNGVIDPLFVKGRLDKLAELNLPIWITEFDSTHKDERVRADNLEKMYRLAFAHPAVEGIVMWGFWAGSHWKGTDGAIVNQDWTLNAAGQRYQQLMDEWTTVVEGTTDQRGMFSFRGFHGTYDMLVDYPGAAAVKQSFTLEPGSGNAKLHIPFDVQDKSIPEAPAKLSAAAADSQVMLSWSKVNGATGYTVKSAVSADGPYTPIAHQLLTETFTHIGLVNRKDYYYVVSASNHLGESPDSAPIRATPRAAGELQTNLVLQYRSADGDNNYQMKPQFTIKNAGKVPIPLSELTIRYYFTPESTQPVDTRIDWAQFGAEHVQTTVVPPSDAAAHAYVELSFLESAGAIPSDTTLGNIQLRIFNSDGSSFDKTNDYSFDPTKKAYTAWEKVTLYRNGELVWGIEPWGAK

SEQ ID NO: 471 - DNA, 1119 bp, Unknown
  Obtained from environmental sample
atgcgaattcactggctggggctcagctcacgcgcaagcctgatgacggcggcgctcctggctgtcacaggcaccaccaaatccgaggactcgcccgcaactttgaaagacgccttcaaggattgtttccggatcggggtcgcgctcaaccagcggcaatttaccgagcaagataccaacggcgcgacgttggtgaaacggcagttcaacgccatctcacccgaaaacgtgatgaagtgggcgaacattcatccccgacccgggcccgatgggtataacttcgaggcggctgaccgttacgtcgagtttggcgagaagaacggaatgttcatcgtcggccatacgctcgtttggcacttccaaacgccgcgctgggtactccagggcgatggcactaacgcggcgacgcgcgagctgctgctgcagcggatgcgcgatcacatccacacggtcgtaggccggtacaaagggcggatcaaggcttgggacgtggtcaacgaagcgctgaacgaagatggcactctgcggcggtcgcagtggtaccggatcatcggcgaagactacatcgtcaaggctttcgaatatgcgcatgaggccgatccgtccgcggaattgcgatacaacgattacgccatcgagaatgagcggaagcgcgacggcgtaatcgcgctcgtgaagaaacttcaggcgcagaaggtcccacttggggggctgggctcgcagacgcatgccaacctgacctggcctaacgccgaatcgctggacaccgccctcacggccttcaccgaactgggtatcccgatctcaatcacggaactggatgtgaccgcctcgcaacgcggtcagctcaaccagagcgccgaggtgtcgcagaatggacaggcgggggagggaggcgtggtggacggggcgaatcagaagctcgccgagcagtacgccagcttcttccgcgtctttctgaagcatcgcaaaaacattgagctcgtgacgttttggggcgtcacggatcgtgactcctggcggcgcattggcaaaccgctgctatttaacgcagaatggcaacccaagccggcctttcacgccgtcatcgccgaggcgaaaaagatcagtgggcaatga

SEQ ID NO: 472 - protein, 372 aa, Unknown
  Obtained from environmental sample
  SIGNAL (1)...(21)
  DOMAIN (34)...(366): Glycosyl hydrolase family 10
  SITE (248)...(251): N-glycosylation site. Prosite id = PS00001
  SITE (269)...(279): Glycosyl hydrolases family 10 active site. Prosite id = PS00591
  SITE (288)...(291): N-glycosylation site. Prosite id = PS00001
MRIHWLGLSSRASLMTAALLAVTGTTKSEDSPATLKDAFKDCFRIGVALNQRQFTEQDTNGATLVKRQFNAISPENVMKWANIHPRPGPDGYNFEAADRYVEFGEKNGMFIVGHTLVWHFQTPRWVLQGDGTNAATRELLLQRMRDHIHTVVGRYKGRIKAWDVVNEALNEDGTLRRSQWYRIIGEDYIVKAFEYAHEADPSAELRYNDYAIENERKRDGVIALVKKLQAQKVPLGGLGSQTHANLTWPNAESLDTALTAFTELGIPISITELDVTASQRGQLNQSAEVSQNGQAGEGGVVDGANQKLAEQYASFFRVFLKHRKNIELVTFWGVTDRDSWRRIGKPLLFNAEWQPKPAFHAVIAEAKKISGQ

SEQ ID NO: 473 - DNA, 1020 bp, Unknown
  Obtained from environmental sample
atgagtgtcatccgcaaggcagcagggatcaaggacgcgtgggcccatgccttccgcgtcggaacggtcaccagcgccgaaattctcgcgaaaaacgtgacaagggaactgatacatacccatttctcgtcgctgacggcggaaaacgccatgaaaatggcccatatccatcccgaagaacgacggtgggatacagccgaggccgacgtcatcgcggatttcgcgcgggaatcctcaatattgttgcgtggcaacgcctttgtctgccaccggcaggtaccggaatgggtattcagggacggaaacggggcggtctcgcaggcgacgctctttggccggctggaatgccatatcgcggccatggccgaacggtacggcgacattgtctatgcctgggacgtcctcagcgaggtgatggacgccggatcgcccgacgggatgcgcatgagcgaatggtaccgcaccggcggcgccggactctgggaattcgctttcaggacggcgcatgccgccgcgccggaatcacgccttttctgcactgactatggcatcgagtcgggcatgaagatggacggaacgctgcgttttctttccggtctccttgacgccggggtcccggtgcacggaatcggcatagagggacactggaactacaaccatcccgacgaaaaaattctccgcaccgcgctcgaacgctactcggccctgggactggacatcgagctgaccgaggtcgacgtatccgcttacgggacggacgaggcgggaatacggtaccccgacataccgcaggaccggaagttcatgcaggcgcagcagttcaagaacatattccggatcgccgccgactatcccgccgtaaagaacatcaccctgaggggccccgccggcggccataccccgtttgacgattttcccgtgcgggactgcaggaactggccgctcctctttgacaccgaatacaaggcgaaaagcttcgtgcccgaactcatcgacaccggattctccctgacggactga

SEQ ID NO: 474 - protein, 339 aa, Unknown
  Obtained from environmental sample
  DOMAIN (9)...(334): Glycosyl hydrolase family 10
  SITE (32)...(35): N-glycosylation site. Prosite id = PS00001
  SITE (201)...(211): Serine proteases, subtilase family, aspartic acid active site. Prosite id = PS00136
  SITE (293)...(296): N-glycosylation site. Prosite id = PS00001
MSVIRKAAGIKDAWAHAFRVGTVTSAEILAKNVTRELIHTHFSSLTAENAMKMAHIHPEERRWDTAEADVIADFARESSILLRGNAFVCHRQVPEWVFRDGNGAVSQATLFGRLECHIAAMAERYGDIVYAWDVLSEVMDAGSPDGMRMSEWYRTGGAGLWEFAFRTAHAAAPESRLFCTDYGIESGMKMDGTLRFLSGLLDAGVPVHGIGIEGHWNYNHPDEKILRTALERYSALGLDIELTEVDVSAYGTDEAGIRYPDIPQDRKFMQAQQFKNIFRIAADYPAVKNITLRGPAGGHTPFDDFPVRDCRNWPLLFDTEYKAKSFVPELIDTGFSLTD

SEQ ID NO: 475 - DNA, 1248 bp, Unknown
  Obtained from environmental sample
atgaagacacatagcttcaacctcagatcacggatcaccttgttgaccgcggcactgcttttcatcggggcaacggccggggccgccacgacacctatcaccctcaaagacgcctacaaagaccatttccttatgggtgtagccatcaaccgcctgattgcaatgggcgatacgaatgtccgggccgacaacgccagccggaccccggaacagctcaagggggacattgccctggtcaaggcgcagttcaacctgatcgtcaatgagaacgatctgaaaccgattctcattcacccgaggccaggaccggacgggtacgacttcgccccagcggatgccttcgtgaagttcggcatggacaacaatatgtatatcgtgggccacaccctcctctggcacagccaggtgcccaactggttcttccaagggtctgctccggcgactccggaaacgccacctgctgccacggacgcggcggtcgcaccccgcggcggacgaggaggtcgcggcgggattaccggccccctggcgacccgcgaggagttgatcgaacgcatgcgcgagcacattcacaccgtcgtcggccgctataagggaaagatcaaggtctgggacgtcgtcaacgaagccctcgccgacggcggcaccgagaccctgcgaagcacgtactggacccaaatcatcgggccggaattcatcgccatggcctttcgattcgcccacgaagccgatccggatgcgatccttcgttacaacgattatggcctggagaaccctgccaagcgtgagaaactcaagaagctgatcgcgtcgctccaggagcagaacgttccggttcatgccatcggcacgcaaacccatatcagcgtctccacgacgttcgaaagaatggatgagaccttgagggacctggcatccatcgggcttcccgtccacatcaccgaactggatgtcaacgccgccgcggggggccagaggggcaccaatgcggacattgccggcactgccgagcgtacggcgggcggcgtggtcagtgaagccgacaagcggctggccgacgcctacgcgaatctcttccgcgcgatcatgaagcacaaggactcggtgaagatggtcacgttctggggcgtcaatgacgcggtttcgtggctcgcacgcggcaccccgctgctgttcgacggcaacaatcagcccaagccggctttcgatgcggtcattcgcgtcgccacggaggcggcacagaactga

SEQ ID NO: 476 - protein, 415 aa, Unknown
  Obtained from environmental sample
  SIGNAL (1)...(28)
  DOMAIN (34)...(409): Glycosyl hydrolase family 10
  SITE (312)...(322): Glycosyl hydrolases family 10 active site. Prosite id = PS00591
MKTHSFNLRSRITLLTAALLFIGATAGAATTPITLKDAYKDHFLMGVAINRLIAMGDTNVRADNASRTPEQLKGDIALVKAQFNLIVNENDLKPILIHPRPGPDGYDFAPADAFVKFGMDNNMYIVGHTLLWHSQVPNWFFQGSAPATPETPPAATDAAVAPRGGRGGRGGITGPLATREELIERMREHIHTVVGRYKGKIKVWDVVNEALADGGTETLRSTYWTQIIGPEFIAMAFRFAHEADPDAILRYNDYGLENPAKREKLKKLIASLQEQNVPVHAIGTQTHISVSTTFERMDETLRDLASIGLPVHITELDVNAAAGGQRGTNADIAGTAERTAGGVVSEADKRLADAYANLFRAIMKHKDSVKMVTFWGVNDAVSWLARGTPLLFDGNNQPKPAFDAVIRVATEAAQN

SEQ ID NO: 477 - DNA, 2199 bp, Unknown
  Obtained from environmental sample
atgaaacggttcctatcctggtccctgaccggcattctggtggcgagcgcgctggtggctttggccttgcccggcagctcgcaggccgccgcgccgctgcggcccttcccgcagcatgtcgcctatgcgccgggctccatccggccttccaacttcacgcaggcccagatggaccagcacgtacgggcattttacgatgattggaaaagtaagtacctggtctccgccggcacgaactctgccgggaaacagctctaccgggtcgccttcgggatcggctcgccggccacggtctcggaagggcagggctacggcatggtgatcgtggcgctgatggccggccacgatcccaacgcccaggccctgttcgacggcttgtggtacttctcccgcaagtaccccagcggcggcgacagccggctgatgagctggaagatcgagaacggccagatcgtcgagggcaacaacaacgcgttcgacggtgacgccgacatcgcctatgggttgctgctggcccacgcccagtggggcagcggcggggatgtgaattacgccaacgaggccaacacggtcatcgccggcatcctggccgcgacgatcggcccgaacagccggctgccgacgctgggcgactgggtcagcccgaacgggtcgccgcacaaccagtacaccccacgctcctcggactttatgccatcccatttccgatcctacggccgggcgaccggcaacagcgtctggaacacggtcgtcgcgaactcgcagaccgtgatcaccagcatccagaccaatcacagcgcgaccaccggcctgctgccggacttcagcacttgcacgaccagcctggtttgcagcccagccagcgccggcttcctggaaggcccgcacgacggccactactactacaacgccggccgcgacccgtggcggatcgggcttgacgcgctgctgaataacgacgcgacctcgcgcacccaggtgcagaaactggtcaactgggtggcgagcagcaccggcggctcggccaccaatatcaaggccggctaccagctcaacggcacgacaatcggcaactacttcaccacattttttgtcgcgccgatcggggttggggcgatgactgattcctcgaaacagcagttcctcaacaacatctacgcctcggtctacaacacgcacgaggactacttcgaggatacggtcgcgctgctgtgcctgctggtgatgaccgggaactactgggacccgaccgtgggaagttccaacacgcctgtgccgaccacgccggtgccgaccacgcccgtgccgaccacaccgaccggcggtgggaccgggctgcgcggcacctattacaacaacagcaacttcaccggctccaccgccacgcgcaccgacccgaccgtgaacttcacctggagcggcgcgccgatcagcggtatcagcggcgacaccttctcggtacgctgggagggccaggtgcagccgccggtcagcggcagctacaccttctcgacggtctcggacgacggcgtgcggctgtgggtcaacggccagcagctgatcaacaactggaccaaccacagcgcgaccaccaacaccgccgcaccagtcacgctgacgggcggacagaagtacgacatccggctggagttctacgacaacaccggcggggccacgatccaactgcgctgggcctaccccggccaggcgacccagatcatcccacagagccggctctacccacccagcgccaccagcacgcccacaccgaccagcacgcccactcgcacgccgaccaacacgcccctgccgggcggcaacctggcgctgaacaagccggcgtcctcctcctccaacgaggacggcacgctgataccggccagagcggtggacggcaacaccggcacccgctgggccagcgccgagggcagcgacccacagtggatctcggtggacctgggcgcgacctacccgatcgcgcgggtgaagctgaactgggaggcggcctacgccacggcctaccggatcgaggtctcggccaacggcagctcgtggacaacgatctacagcaccagcagcggcaacggcgggatcgatgacctgaccggcctgtccggcagtgggcgctacgtgcggatgtacggcacggcgcgcggcacgccctatgggtactcgctgtgggagtttgaggtgtactga

SEQ ID NO: 478 - protein, 732 aa, Unknown
  Obtained from environmental sample
  SIGNAL (1)...(29)
  DOMAIN (34)...(411): Glycosyl hydrolases family 8
  DOMAIN (442)...(578): PA14 domain
  DOMAIN (613)...(729): F5/8 type C domain
  SITE (51)...(54): N-glycosylation site. Prosite id = PS00001
  SITE (268)...(271): N-glycosylation site. Prosite id = PS00001
  SITE (357)...(360): N-glycosylation site. Prosite id = PS00001
  SITE (458)...(461): N-glycosylation site. Prosite id = PS00001
  SITE (476)...(479): N-glycosylation site. Prosite id = PS00001
  SITE (531)...(534): N-glycosylation site. Prosite id = PS00001
  SITE (691)...(694): N-glycosylation site. Prosite id = PS00001
MKRFLSWSLTGILVASALVALALPGSSQAAAPLRPFPQHVAYAPGSIRPSNFTQAQMDQHVRAFYDDWKSKYLVSAGTNSAGKQLYRVAFGIGSPATVSEGQGYGMVIVALMAGHDPNAQALFDGLWYFSRKYPSGGDSRLMSWKIENGQIVEGNNNAFDGDADIAYGLLLAHAQWGSGGDVNYANEANTVIAGILAATIGPNSRLPTLGDWVSPNGSPHNQYTPRSSDFMPSHFRSYGRATGNSVWNTVVANSQTVITSIQTNHSATTGLLPDFSTCTTSLVCSPASAGFLEGPHDGHYYYNAGRDPWRIGLDALLNNDATSRTQVQKLVNWVASSTGGSATNIKAGYQLNGTTIGNYFTTFFVAPIGVGAMTDSSKQQFLNNIYASVYNTHEDYFEDTVALLCLLVMTGNYWDPTVGSSNTPVPTTPVPTTPVPTTPTGGGTGLRGTYYNNSNFTGSTATRTDPTVNFTWSGAPISGISGDTFSVRWEGQVQPPVSGSYTFSTVSDDGVRLWVNGQQLINNWTNHSATTNTAAPVTLTGGQKYDIRLEFYDNTGGATIQLRWAYPGQATQIIPQSRLYPPSATSTPTPTSTPTRTPTNTPLPGGNLALNKPASSSSNEDGTLIPARAVDGNTGTRWASAEGSDPQWISVDLGATYPIARVKLNWEAAYATAYRIEVSANGSSWTTIYSTSSGNGGIDDLTGLSGSGRYVRMYGTARGTPYGYSLWEFEVY

SEQ ID NO: 479 - DNA, 636 bp, Unknown
  Obtained from environmental sample
atgaaggtcttcgcaaccttggctggcctcttggccacggccctcgcggccccttccaccgagcacgcgcttgtggcccgccgtaacggtatcgactacgtccaaaactacaacggcaacttgggtgcctttagctacaaccagggtgctggccagttctccatgtactgggacaacggtgtgaacaatgacttcgtcgttggtctgggatggcgcactggctcgaagagccccatcacctactcggccacctatgacgccgccagctctggctcgtaccttgctgtgtacggctggatcaactcgccccaggccgagtactacgttgtcgagtcctacggcacctacaacccctgcagtcaggcccagagcttgggcacgatcacctcggacggaggtacctaccaggtctgcaccgacacccgctacaaccagccctccataactggtaccagcaccttcacccagttcttctcggtccgccagaacaagcgcacctccggcacggtcaccatcaacaaccacttcaacttctgggcccagcacgggttcggcaacagcaacttcaactaccaggtcatggccgtcgaagcattcaacggtcacggtcacgccagcgtccaggtctctggttaa

SEQ ID NO: 480 - protein, 211 aa, Unknown
  Obtained from environmental sample
  SIGNAL (1)...(16)
  DOMAIN (27)...(209): Glycosyl hydrolases family 11
  SITE (104)...(114): Glycosyl hydrolases family 11 active site signature 1. Prosite id = PS00776
MKVFATLAGLLATALAAPSTEHALVARRNGIDYVQNYNGNLGAFSYNQGAGQFSMYWDNGVNNDFVVGLGWRTGSKSPITYSATYDAASSGSYLAVYGWINSPQAEYYVVESYGTYNPCSQAQSLGTITSDGGTYQVCTDTRYNQPSITGTSTFTQFFSVRQNKRTSGTVTINNHFNFWAQHGFGNSNFNYQVMAVEAFNGHGHASVQVSG

SEQ ID NO: 481 - DNA, 585 bp, Artificial Sequence
  Synthetically engineered
atggcccagacctgcctcacgtcgccccaaaccggctttcacaatggcttcttctattccttctggaaggacagtccgggcacggtgaatttttgcctgttggagggcggccgttacacatcgaactggagcggcatcaacaactgggtgggcggcaagggatggcagaccggttcacgccggaacatcacgtactcgggcagcttcaatacaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagttga

SEQ ID NO: 482 - protein, 194 aa, Artificial Sequence
  Synthetically engineered
MAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVS

SEQ ID NO: 483 - DNA, 2529 bp, Unknown
  Obtained from environmental sample
atgaaaaaaagattgttagcgttgatagtgacattagtttttattatctcattgtttaatcccatattcaccacacctttaacaaatgtagcaaaggctcaaagtaaccaaacaaatttaaaatttgactttgaaaacggtactcaaggttggggagcaagaggtgtttcaacaactattgcaaccgtttacgagcaagcttatgaaggaagttattctttaaaggtttcaggtagaagttcaacgtgggatggagcagttgtggatatcacatcaagtatttcagcaaatgtcacctatacagtttctttatttgttcgtcacagtgatgtaaaaccacaaagattttctgtctatgtatatgtcaaagataacacaggcgaaaaatacatccaggttgcagacaaagtggttatgccaaacttttggaagcagctctttgggaagttcacaatcacaacatcaaatccaattcaaaaagtagaacttcttgtatgtgttccatctaacaaatctttaggattttatcttgacaatgtagttgttacttcagcacaaccagcttcctcgggtgttgttaaatcttgcacatttgaaagcggtagcactgagggttttgttcagagaggttcagcttcattgacagttgtcgacggtgtatactatcattctccaacaaaagcattatatgtgacaggaaggacagctacatggcagggtgcacagatagatatgacaagtttgcttgagaagggcaaggattatcagtttagcatatgggtatatcaaaatagtggaagtgatcagaagataacccttacgatgcaaaggaagaatgaagatggaactacgagttatgattctataaagtatcagcaaacagttccatctggtacatggacagaagtgacaggttcatacacagtgcctcagacagcaacacagcttatattctatgttgaatcaccgaatattaattttgacttctaccttgatgactttacagcggttgacaaaaacccacctgttgtaaacccagggcttgttaaatcttgcacatttgaaagcggtagcgctgaaggttttgttcagagaggttcagcttcattgacagttgtcgacggtgtatactatcattctccaacaaaagcattgtatgtgacaggaaggacagctacatggcagggtgcacagatagatatgacaagcttgcttgagaagggtaaggattatcagtttagcatatgggtatatcaaaatagtggaagtgatcagaagataacccttacgatgcaaaggaagaatgaagatggaactacgagttatgattctataaagtatcagcaaacagttccatctggtacatggacagaagtaacaggttcatacacagtgcctcagacagcaacacagcttatattctatgttgaatcaccgaatattaattttgacttctaccttgatgactttacagtaatagataaaaatccagtgacggtaccgattgcagcaaaagaacccgaatgggaaattccgtcactttgtcagcaatatagtcaatatttctcaataggtgttgcaataccgtataaagtacttcaaaatcctgttgaaagagcaatggtgttaaaacacttcaacagtataacagctgaaaatgagatgaaacctgacgctctgcaaagaacagaagggaactttacattcgatatagcagaccagtatgtaaacttcgcacagcaaaacggtattggaattagagggcatactctggtatggcacagccaagtacctaattggttcttccagcacagtgatggaacttcacttgatccaagcaatccagatgataagcaacttttgagagatagattgaaaaatcatattcaaactgttatgtcaagatacaaagggaaagtctatgcatgggatgttgtaaacgaggcaatagatgaaagccagcctgatggatttagaagaagcgaatggtacagaatacttggtccaacacctgagacaaatggtattccagaatacattgtgcttgctttcaggtatgcaagagaggcagatccagatgcaaaacttttctacaatgactacaacacagagatatctaaaaaaagacagtttatatatgacatggtaaaaaagctacatgatatgggtttaattgatggtgttggtttgcaagggcatataaatgttgattctccaacagtaaaagatatagaagatacaatcaatcttttctcaacaattcctggacttgagatacagataacagagcttgacataagcgtttacacaagcagcagtcagcgttatgatacgcttcctcaggatataatgataaaacaagcaatgaagtttaaagaactatttgaaatgttaaagagacatagtgatagagtcacaaatgtgacactttggggacttaaggatgattattcatggctttcaaaggatagaaataactggccattactttttgacagcaactaccaggcaaaatacaactactgggca

SEQ ID NO: 484 - protein, 843 aa, Unknown
  Obtained from environmental sample
  SIGNAL (1)...(33)
  DOMAIN (36)...(185): Carbohydrate binding domain
  DOMAIN (190)...(339): Carbohydrate binding domain
  DOMAIN (346)...(495): Carbohydrate binding domain
  DOMAIN (513)...(843): Glycosyl hydrolase family 10
  SITE (36)...(39): N-glycosylation site. Prosite id = PS00001
  SITE (46)...(49): N-glycosylation site. Prosite id = PS00001
  SITE (98)...(101): N-glycosylation site. Prosite id = PS00001
  SITE (172)...(175): N-glycosylation site. Prosite id = PS00001
  SITE (574)...(577): N-glycosylation site. Prosite id = PS00001
  SITE (767)...(777): Glycosyl hydrolases family 10 active site. Prosite id = PS00591
  SITE (819)...(822): N-glycosylation site. Prosite id = PS00001
MKKRLLALIVTLVFIISLFNPIFTTPLTNVAKAQSNQTNLKFDFENGTQGWGARGVSTTIATVYEQAYEGSYSLKVSGRSSTWDGAVVDITSSISANVTYTVSLFVRHSDVKPQRFSVYVYVKDNTGEKYIQVADKVVMPNFWKQLFGKFTITTSNPIQKVELLVCVPSNKSLGFYLDNVVVTSAQPASSGVVKSCTFESGSTEGFVQRGSASLTVVDGVYYHSPTKALYVTGRTATWQGAQIDMTSLLEKGKDYQFSIWVYQNSGSDQKITLTMQRKNEDGTTSYDSIKYQQTVPSGTWTEVTGSYTVPQTATQLIFYVESPNINFDFYLDDFTAVDKNPPVVNPGLVKSCTFESGSAEGFVQRGSASLTVVDGVYYHSPTKALYVTGRTATWQGAQIDMTSLLEKGKDYQFSIWVYQNSGSDQKITLTMQRKNEDGTTSYDSIKYQQTVPSGTWTEVTGSYTVPQTATQLIFYVESPNINFDFYLDDFTVIDKNPVTVPIAAKEPEWEIPSLCQQYSQYFSIGVAIPYKVLQNPVERAMVLKHFNSITAENEMKPDALQRTEGNFTFDIADQYVNFAQQNGIGIRGHTLVWHSQVPNWFFQHSDGTSLDPSNPDDKQLLRDRLKNHIQTVMSRYKGKVYAWDVVNEAIDESQPDGFRRSEWYRILGPTPETNGIPEYIVLAFRYAREADPDAKLFYNDYNTEISKKRQFIYDMVKKLHDMGLIDGVGLQGHINVDSPTVKDIEDTINLFSTIPGLEIQITELDISVYTSSSQRYDTLPQDIMIKQAMKFKELFEMLKRHSDRVTNVTLWGLKDDYSWLSKDRNNWPLLFDSNYQAKYNYWA

SEQ ID NO: 485 - DNA, 1239 bp, Unknown
  Obtained from environmental sample
atgatcagggtttattcagccggattcggggggactaatgatccggttgaaattgttaaagttgagttctttgcggattcaataaaaatccatgagagcttcgaacatgatcaacataccttttcgtttttatgggaggatgtacagtcgggtacctacaggataactgccaccgctaccgatgagcttggaacaaccttcacctctgccggtgtcattgttaaggtcggagaggatcctgttatacggagaggcctgagtgccggcaaaggaaaataccttggcaatattgtcgggcatcatggtatccggcctgatttcaatgaatactggaacggggttactgcagagaacggagccaagtggggtgttgtggaagggacccgtgacgtaatgaactggacgcaggctgactacgcctacaaccatgcatattatcacaatttaatgtacaggtaccatgcaattgcatggggaagtcagtatccgcagtggatcactgatcttgagccggaggaattccagcatgaactcgaagagtatatggctgccgttgccgaaagatatcctctgatcgatcaggtagatgtcattaatgagcagttgcgaacccatgctgcgggcaccgtatatttcagggacgcgctcggcggtaccggggagaccggatatgactggcagatctggatatttgagaaggcgcgtcagtattttcctgatgcaaagcttgtgcttaatgactacggactggaaaatgacccgactgcaatcaatgagatgttggggctggtcagagttctaagggacagaggactgattgacggatttggtacgcaggcccattattttaatgttgatcagatggcaacccagccaaatactttgagatcgaggattgatctgatggcctcgggtggtatacccgtatatgttacagagctggatcttcggggcagctctaataatgatgcatcccagcttttcagctacgagaggactttccctgtattctgggagcatcccgctgttgctggcatcaccctgtggggatatgtgacagggcagacctggcgggagggtaccggacttatcaacagtgatgggagcaagagaccggctatgctatggcttgaagaatatatggctgatcagcctgatattggcttccctcattccggaattgagcctgaaccggatagtaacctcctttataacggtgagttcaactctcgtgccgaa

SEQ ID NO: 486 - protein, 413 aa, Unknown
  Obtained from environmental sample
  DOMAIN (84)...(381): Glycosyl hydrolase family 10
  SITE (135)...(138): N-glycosylation site. Prosite id = PS00001
  SITE (310)...(320): Glycosyl hydrolases family 10 active site. Prosite id = PS00591
MIRVYSAGFGGTNDPVEIVKVEFFADSIKIHESFEHDQHTFSFLWEDVQSGTYRITATATDELGTTFTSAGVIVKVGEDPVIRRGLSAGKGKYLGNIVGHHGIRPDFNEYWNGVTAENGAKWGVVEGTRDVMNWTQADYAYNHAYYHNLMYRYHAIAWGSQYPQWITDLEPEEFQHELEEYMAAVAERYPLIDQVDVINEQLRTHAAGTVYFRDALGGTGETGYDWQIWIFEKARQYFPDAKLVLNDYGLENDPTAINEMLGLVRVLRDRGLIDGFGTQAHYFNVDQMATQPNTLRSRIDLMASGGIPVYVTELDLRGSSNNDASQLFSYERTFPVFWEHPAVAGITLWGYVTGQTWREGTGLINSDGSKRPAMLWLEEYMADQPDIGFPHSGIEPEPDSNLLYNGEFNSRAE

SEQ ID NO: 487 - DNA, 1152 bp, Unknown
  Obtained from environmental sample
atgcaaactgtcctcctcaccgtctcgcttgtgtttctggcaagctgcatgatggccaccacgaacagtgattcacccggttccgctcggaccgccgccaccctcaggcaggcggccggggaccgcgttctcatcggcacggcgatcatgtcgcgtcatctggacgacccgcaactcgccgatctcgtcgcacgacagttcaacagcctcaccggtgaaaatgaattcaaacccgcctcgctccaaccacgccccggcgagttcaccttcgacgcggccgacagactcgccgacttcgcacggcagcacgacatgaagttgatcgggcacacgctcgtgtggcacaaccaggcgccgaattggatgttcgaggatgaatccggtcagccgctgccgcgcgagcaggcgcttgagaatctcaagcatcacatcgacacggtcgtcaagcatttcaagggccgcgtcgtcggctgggatgtggtcaacgaagccatcagcgaccgggaggatgagtacctccgtgatacccccgcccgccgcgcgatcggggatgattacatcgcccgcgcgtttgaattcgcgcacgcggccgacccggatgtcgagctgtattacaacgactacagcatcgagcacccgacgaagcgcgagaagacgctgcggctgatccgcgagttgcaggccgcaggcgtccgcatcgacgccgtcggcatccaggggcactggctcatcgacagcccggacgtgcaggtcatcgacgacgcgatcgctgcgtatgcgagccggggagtgaaggtgatgatcaccgagctggatgtcgatcccctgccgcgccggcgtgacggcggggcggacctcagcgccgtcgagcttgaggggctcgacccgtacatccaaggtcttacggacgaagcgcagcagcggctcgccgatcgataccgcgaagtcctcgaagtgatgatgaagcacgtcaatcgcggcgacctcacgcgcatcaccttctggggcacgcacgacggcacaagctggctgaacaacttccccgtccgcggccgcaccaatcacccgctgctgtgggatcgcgagctgtcgccgaaaccagcttttcacgcggtgattgaggttctcgcgaggcccgccggtgcacgctga

SEQ ID NO: 488 - protein, 383 aa, Unknown
  Obtained from environmental sample
  DOMAIN (34)...(376): Glycosyl hydrolase family 10
  SITE (267)...(277): Glycosyl hydrolases family 10 active site. Prosite id = PS00591
MQTVLLTVSLVFLASCMMATTNSDSPGSARTAATLRQAAGDRVLIGTAIMSRHLDDPQLADLVARQFNSLTGENEFKPASLQPRPGEFTFDAADRLADFARQHDMKLIGHTLVWHNQAPNWMFEDESGQPLPREQALENLKHHIDTVVKHFKGRVVGWDVVNEAISDREDEYLRDTPARRAIGDDYIARAFEFAHAADPDVELYYNDYSIEHPTKREKTLRLIRELQAAGVRIDAVGIQGHWLIDSPDVQVIDDAIAAYASRGVKVMITELDVDPLPRRRDGGADLSAVELEGLDPYIQGLTDEAQQRLADRYREVLEVMMKHVNRGDLTRITFWGTHDGTSWLNNFPVRGRTNHPLLWDRELSPKPAFHAVIEVLARPAGAR

SEQ ID NO: 489 - DNA, 1170 bp, Unknown
  Obtained from environmental sample
atgaagccaattttgcgttcatccctctcctgcctcggcatccttgtcctcgcaacttgcccaactggctgcaaagacaagccgaagcccgatcccgcaacgagcgcgcccacgctagccgaagcctacgccccctacttcactatcggcgcggccctaaacgaaagccaggtagaggggccgcccgcggagctggtcaccaagcacttcaactccatcaccgccgagaacatcatgaagtggggcctgatccatccggagcccggccagtacaactgggagccggtcgaccgcttcgtcgatttcggcgaggccaatggcatggagattatcggccacaccctggtctggcacagccaaacgcccgattgggtcttccgcgacgaagagggcaacctgctcacccgcgagcccatgctcgagcgcatgcgcgatcacatccacgccgtcgtcgggcgctacaagggccgtatccatggctgggatgtcgtcaacgaagccctcaacgaggacggcagcctgcgggagtcgctctactaccagatcatcggtccggactacatcgccaaagccttcgaatacgcccacgaagccgatccggaggccgaactctactacaacgactacaccatcgaaaacccggacaagcgggctggagccgtacgcatcgtcaaggacctgcaggaacgcggcgtccgcatcaccggcgtgggcatacaggaacacgtcaacatgacctggcccagccagcagctgctgcgcgagaccatccgcgacttcgttgccctcggcgtgaccgtcatgatcaccgagctcgacgtcgatgtcctgccctccgccttccagcaccaaggagccgacgtttcgctcaacgcagagctgcgcgacgagctcaacccctacccgaacggattgcccgaggccgtgcagcgcgcccaagcccagcgctacgccgacctcttttccgtgtacctggaattcaaggacagcatcacccgcgttaccctttggggactggacgacggcggttcctggctcaacgactggcccgtgcgcggacgcacgagctacccccttctctttgaccgcgagctgcaacccaagcccgccttcgacgccgtgctccggctcggactcgaacaccgacgccaggacagcggcggctactga

SEQ ID NO: 490 - protein, 389 aa, Unknown
  Obtained from environmental sample
  DOMAIN (38)...(378): Glycosyl hydrolase family 10
  SITE (54)...(57): N-glycosylation site. Prosite id = PS00001
  SITE (247)...(250): N-glycosylation site. Prosite id = PS00001
  SITE (268)...(278): Glycosyl hydrolases family 10 active site. Prosite id = PS00591
MKPILRSSLSCLGILVLATCPTGCKDKPKPDPATSAPTLAEAYAPYFTIGAALNESQVEGPPAELVTKHFNSITAENIMKWGLIHPEPGQYNWEPVDRFVDFGEANGMEIIGHTLVWHSQTPDWVFRDEEGNLLTREPMLERMRDHIHAVVGRYKGRIHGWDVVNEALNEDGSLRESLYYQIIGPDYIAKAFEYAHEADPEAELYYNDYTIENPDKRAGAVRIVKDLQERGVRITGVGIQEHVNMTWPSQQLLRETIRDFVALGVTVMITELDVDVLPSAFQHQGADVSLNAELRDELNPYPNGLPEAVQRAQAQRYADLFSVYLEFKDSITRVTLWGLDDGGSWLNDWPVRGRTSYPLLFDRELQPKPAFDAVLRLGLEHRRQDSGGY

SEQ ID NO: 491 - DNA, 1530 bp, Unknown
  Obtained from environmental sample
atgaacaattatagagcttttgtgttgggcttgtgctggctaggtgggctaatgttgacggggtgtggagccgaccaaggcagtccagaccccggcacctccagtgccaccagcagcaccagttcatccagtgagggcttttccagtgctgtcagcgagagttctgccagtgcgatatccagctctgcgtcatccgcgccgcccaactatcaggtgccagagaataatttcgcggtgaacggcgatctggagcagggacttaccaattggggggctattggcggaacggtcagtcgagccacctctgaaagtcgaagcggcgccgccagcgcgctgatcaccgaccgtacagcgtcgtggaatggacttaccttcaatgttggtcaactgacgcaaggcaacgaatacgcagtggcggtctgggtcaagctggcttcgggttctccagatgccactgtaatccttacggccaagcgccaagacgatgatgatccctccaccttcctagaatacaccaacattgctatggctactgcttcagcgagtagttggactttgttgcacggatactacacccaggccggcacgccatttcaacactttattatcgagtctgctgacgaaacggtcagcttctacgccgatgacttctctgtggcgggtgaagtagacccagtcgtcggcgaagggcatgacttctttgtcggaaatatcaccacctcgggcagtgtaaggtcggattttatcaactattgggatcagattacgccagagaatgagggtaaatgggaatctgtagagcgcgtaagaggagtctacgactggagtggcactgaccgcgtctacgcatacgcccgtgagcataacatcccggtgaaggctcatgcttttgtctggggaagccaataccccagttggatcacctctctgagtccgcaagagcaagccgaggccattgagcgctggatacgtgactactgcgctcgatatcccgataccgcgatgatcgatgtggttaatgaagccacgcctggtcatgcgccggccgagtttgcccgcagcgcttttggtgaaaactgggttattcggtcgttcgagttggcccgccagtattgcccaaatgccattttaatactcaatgattacaacgtacttagctggaacacagacggttttatcaatatggcacgtccagttattaacgctggagtggtagatgcacttggtttgcaagcgcacggtttagccgactggtccttggcggatatagagcgaaaacttaatgaagtggcggcgttggggttgcccatctatatctctgaatacgatatcgaaaaaaccgatgatcaagagcaactcgatgtaatgcgcacccagttcccgctcttttataaccatccctcggtagtggggattaccctttggggttacgtagaagggcgaacttggaggccgggaaccgggctaattcatgaggacggaaaccaccgccccgcgatgaattggttgatggattatttggggcgatag

SEQ ID NO: 492 - protein, 509 aa, Unknown
  Obtained from environmental sample
  SIGNAL (1)...(65)
  DOMAIN (75)...(222): Carbohydrate binding domain
  DOMAIN (205)...(507): Glycosyl hydrolase family 10
  SITE (240)...(243): N-glycosylation site. Prosite id = PS00001
  SITE (380)...(394): Trp-Asp (WD) repeats signature. Prosite id = PS00678
  SITE (440)...(450): Glycosyl hydrolases family 10 active site. Prosite id = PS00591
MNNYRAFVLGLCWLGGLMLTGCGADQGSPDPGTSSATSSTSSSSEGFSSAVSESSASAISSSASSAPPNYQVPENNFAVNGDLEQGLTNWGAIGGTVSRATSESRSGAASALITDRTASWNGLTFNVGQLTQGNEYAVAVWVKLASGSPDATVILTAKRQDDDDPSTFLEYTNIAMATASASSWTLLHGYYTQAGTPFQHFIIESADETVSFYADDFSVAGEVDPVVGEGHDFFVGNITTSGSVRSDFINYWDQITPENEGKWESVERVRGVYDWSGTDRVYAYAREHNIPVKAHAFVWGSQYPSWITSLSPQEQAEAIERWIRDYCARYPDTAMIDVVNEATPGHAPAEFARSAFGENWVIRSFELARQYCPNAILILNDYNVLSWNTDGFINMARPVINAGVVDALGLQAHGLADWSLADIERKLNEVAALGLPIYISEYDIEKTDDQEQLDVMRTQFPLFYNHPSVVGITLWGYVEGRTWRPGTGLIHEDGNHRPAMNWLMDYLGR

SEQ ID NO: 493 - DNA, 1959 bp, Unknown
  Obtained from environmental sample
atgcatgttctcgcgaaaatctgcttggtcgtgctcatcgcgctgtcgacatgcgccagcacgatggcacagaccagcatcaacggctccagtctcgccttgcagtccacgggatccaacgtgatcccatccaccggttacgtgggcacgtatcttgtcgttcccgattcgggcgacggcggctcgacggtcaatctgaatctcagtgcccagcggggtgccggcagcggcaatccccacctgaacatcgttgtcgccgattcgcagtttggcttcaatgtcacgactttcggagcgcagaactacaacacgggcaatttctggctgccggccggcacgcacttcgtccgcgtcgagcgcgattcgcccagcaacacgcccagcatcacgcgatcgatgacaatcaacaatctgagcgtgactggggcaacctttagcaatagcaacaatacgtcgaacgcacggaacgcggctaattcctacatcgagaattttcgcaagggcgaccaaaacatcgccctccacggcgctacgcccggaacgcccgtgcatgtgaagctggtgaatcacgcctttaacttcggcacggccattggcggacacgacctgaccacactcaacaacttcctcaacaactccaactacaccagccgcctgttggagaatttcaacatgatcgtgccgggcaacgttggcaaatggggccacagccaactgccaactcagattcaggcgatggacacctttctcaattttgccgagaacaacaatctccgcgcccgcatgcataacctgatttggcagaaccagcagcccactagcatcaacagtctaatcaaccaggcacttggcggcagcacgtcggccaagaaccagctccgccaggaaatctccaatcgcatcagttactacgtcggcagtcgcggccaccgctacatggagctggacgtgctcaacgaggcccaccgagccccggactactggaacattttctcgcccactgagcttgctgatattcatgccgaggtccgcaacgttgccgcggccaatggccacgacatcggtctctacatcaacgactacaaccttctgcagcacaacagcgctcccagcttctatcccgacaccggcgcatcgaattacgccaactggtatcgcaattacgccgaggagctgaacaacgccggctttggggaagtcgtgagcggcatcggcattcagtactacgtccgccacgacggaaccgtcagcgtaccgcggattcagcaggtcttccagaatatgggcgtcaccggcctgcccctcacgctcaccgagtttggcgttcaaacgcacaacaatcctacactcgcccagagtgccgactatcttgaggacacgattcgcatggtctttggaaccccccatgccacgacgtttatgatgtgggggttctgggaaaacgatgtttgggtgggcgggccgttggccgcgctgtacgacgccaattggaacctaaccgtccccggccagcgctatcagcaactcatgtccgactggtccaccgaggaaacgctgatagtcgggccggacggcaccatcgacctcagcggtttctatggcgactatgaaatcaccatcggcgatgaaacgttcgaattcacccacgccaagggctcgcccggccagtcgctcattgtcggaccgttcttgccgggcgactacaacggcgacggcgtggtggacgtgctcgattacgtcgtgtggcggaacagccgcggggccgactggctcccgaaccgcgatctggaagctgacggtccggttgggcaggacgattacgccgcctggcaggctaacttcggcagcacgctcgacggcggcagcgccagctccctagcgacgattcccgagccggccagcggcatgctgctgctcttcggcttggtcgccgcgatctgcctacggatgcgacgttaa

SEQ ID NO: 494 - protein, 652 aa, Unknown
  Obtained from environmental sample
  SIGNAL (1)...(23)
  DOMAIN (184)...(510): Glycosyl hydrolase family 10
  SITE (28)...(31): N-glycosylation site. Prosite id = PS00001
  SITE (68)...(71): N-glycosylation site. Prosite id = PS00001
  SITE (94)...(97): N-glycosylation site. Prosite id = PS00001
  SITE (139)...(142): N-glycosylation site. Prosite id = PS00001
  SITE (151)...(154): N-glycosylation site. Prosite id = PS00001
  SITE (214)...(217): N-glycosylation site. Prosite id = PS00001
  SITE (505)...(508): N-glycosylation site. Prosite id = PS00001
  SITE (575)...(587): EF-hand calcium-binding domain. Prosite id = PS00018
MHVLAKICLVVLIALSTCASTMAQTSINGSSLALQSTGSNVIPSTGYVGTYLVVPDSGDGGSTVNLNLSAQRGAGSGNPHLNIVVADSQFGFNVTTFGAQNYNTGNFWLPAGTHFVRVERDSPSNTPSITRSMTINNLSVTGATFSNSNNTSNARNAANSYIENFRKGDQNIALHGATPGTPVHVKLVNHAFNFGTAIGGHDLTTLNNFLNNSNYTSRLLENFNMIVPGNVGKWGHSQLPTQIQAMDTFLNFAENNNLRARMHNLIWQNQQPTSINSLINQALGGSTSAKNQLRQEISNRISYYVGSRGHRYMELDVLNEAHRAPDYWNIFSPTELADIHAEVRNVAAANGHDIGLYINDYNLLQHNSAPSFYPDTGASNYANWYRNYAEELNNAGFGEVVSGIGIQYYVRHDGTVSVPRIQQVFQNMGVTGLPLTLTEFGVQTHNNPTLAQSADYLEDTIRMVFGTPHATTFMMWGFWENDVWVGGPLAALYDANWNLTVPGQRYQQLMSDWSTEETLIVGPDGTIDLSGFYGDYEITIGDETFEFTHAKGSPGQSLIVGPFLPGDYNGDGVVDVLDYVVWRNSRGADWLPNRDLEADGPVGQDDYAAWQANFGSTLDGGSASSLATIPEPASGMLLLFGLVAAICLRMRR

SEQ ID NO: 495 - DNA, 1125 bp, Unknown
  Obtained from environmental sample
atgagaacgcgagttttgacgctgctagggggatttctgggatcgacgattgctgcgagcgtgacggtcgctgagcggccaagcctgaaggatgtgtttgcggacgattttcgcgtcggggtcgcgctcggtacgtcgcaagtgatgggcaaggagccggacgcgatgcacctggccgcccggcacttcaacacgatcacgaacgagaatctgctcaaatgggccgaggtgcacccggagccggagcgctaccatttcgagtcggccgaccgcttcgtcgaattcggcgagaagcatgggatgtggatcgtcggccacacgctggtctggcacagccagacgcccgactgggtgtttgaagatgcggagggccggccgctcgatcgggaggcgctcatcgagcggatgcgggcgcatatccacacgatcgtcgggcggtacaaggggcgagtccacgcctgggacgtggtcaacgaggccgtgctcgacgacggctcgtggcgcgaaacgaagtggcgcgagatcatcggcccggactatatcgaattggcctttcggtttgcccacgaggtcgatccggaggcggagctctactacaacgactacaacgagtggcacgcgggcaagcgcgcggcgatcgtccggctcgtgcaagatttgcaggccaagggagtgcggatcgacgggatcggactgcaaggacactggggaatggactacccggagctcgaagagctggaccacatgtttacggagtacggcaagctgggcgtgaagctcatgatcacggaattggacgtgaccgtgattccgctgcctggtcgggacacgggcgccgaggtgacgcgaaggggccaggctggttccgggatgaatccttatcctgatggactgccggccgatcagcaacaagcgttggccgagcggtacgccgcttttttcaggctctttatgaagcaccgcgataagatcgaccgcgtgacgttctggggcgtgcataacggccagacgtggcgcaacaactggcccattccaggccgcagtgactatccgctactcttcgatcgccagttgcagccgaagccggcgtttgacgcggtgattgaagtggccagcgagcgttaa

SEQ ID NO: 496 - protein, 374 aa, Unknown
  Obtained from environmental sample
  DOMAIN (28)...(371): Glycosyl hydrolase family 10
MRTRVLTLLGGFLGSTIAASVTVAERPSLKDVFADDFRVGVALGTSQVMGKEPDAMHLAARHFNTITNENLLKWAEVHPEPERYHFESADRFVEFGEKHGMWIVGHTLVWHSQTPDWVFEDAEGRPLDREALIERMRAHIHTIVGRYKGRVHAWDVVNEAVLDDGSWRETKWREIIGPDYIELAFRFAHEVDPEAELYYNDYNEWHAGKRAAIVRLVQDLQAKGVRIDGIGLQGHWGMDYPELEELDHMFTEYGKLGVKLMITELDVTVIPLPGRDTGAEVTRRGQAGSGMNPYPDGLPADQQQALAERYAAFFRLFMKHRDKIDRVTFWGVHNGQTWRNNWPIPGRSDYPLLFDRQLQPKPAFDAVIEVASER

SEQ ID NO: 497 - DNA, 1008 bp, Unknown
  Obtained from environmental sample
atgtggcagataaataacagtgccgaagacgcgcctaaatatcctacagtggcgagccaaaataatgccgcagtggggacttggtactccctgagtgggacatggacgggaaagccaaccgctagtggcccagtcctgtacctaaacaatgacaagaccagcggcaccacgttctactatattgacaatttcactgtcacaataactgaaacaagtaccggagtcggaggcggtgacggaccgccaaccattacaaccaccccgttagacaaaaacgccgcaggcgtgcaaacgtttaccagcaattcaggcggaaataagaccctttcaggttcaccctatggctacgaaatgtggacagagggcggaaatgacaacaaacttatatggtacgggccaaaccagggaggcggtgccgcgttcagggcggaatggaataaccccaatgactttttaggccgcgtcggttatttctggaatcagggtaaacctttcactgattataaaaatgtttattgcgattttaactatacaaggtcgggcagaaatacagccggaagttattcctatataggtatttacggctggtcaagaaacccaaatgccgcaaaggaagaggagaagttgatagaatactacatcgtggatgactggttcggtaattcatctcaatcagacacctctcccatggggaccggaacaacagggggcagcgtagtcggcagttatacgctggacggcgcgacttacagtgttattaaaaatgtgagggtgaacaagccttcaatagacggcgataaaacatttacacaattcttcagcatacgccaaacgctgcgcaaaaccgggacaatttccgttaccgagcatttcaaaaaatgggacgcattaaatatgaagcttggttcaaatatgtacgaatgtaaattccttgtcgaagcgggcggcggcaccggctggctggaatttacctacctgaaattctcgcaggaggacaatcccaggtag

SEQ ID NO: 498 - protein, 335 aa, Unknown
  Obtained from environmental sample
  DOMAIN (111)...(325): Glycosyl hydrolases family 11
  SITE (5)...(8): N-glycosylation site. Prosite id = PS00001
  SITE (63)...(66): N-glycosylation site. Prosite id = PS00001
  SITE (107)...(110): N-glycosylation site. Prosite id = PS00001
  SITE (178)...(181): N-glycosylation site. Prosite id = PS00001
  SITE (224)...(227): N-glycosylation site. Prosite id = PS00001
MWQINNSAEDAPKYPTVASQNNAAVGTWYSLSGTWTGKPTASGPVLYLNNDKTSGTTFYYIDNFTVTITETSTGVGGGDGPPTITTTPLDKNAAGVQTFTSNSGGNKTLSGSPYGYEMWTEGGNDNKLIWYGPNQGGGAAFRAEWNNPNDFLGRVGYFWNQGKPFTDYKNVYCDFNYTRSGRNTAGSYSYIGIYGWSRNPNAAKEEEKLIEYYIVDDWFGNSSQSDTSPMGTGTTGGSVVGSYTLDGATYSVIKNVRVNKPSIDGDKTFTQFFSIRQTLRKTGTISVTEHFKKWDALNMKLGSNMYECKFLVEAGGGTGWLEFTYLKFSQEDNPR

SEQ ID NO: 499 - DNA, 1155 bp, Unknown
  Obtained from environmental sample
atgattacattcagaaatacattgtttaccgtcgttatactcgccattgtcggcagcgggctgccggcatgcgaagccgctccgccggaaaatgcggatccgtccttacacgaggcgtatgcagatgcgtttctgatgggcaccgcactcaatctggcgcagatcgacggaagggatgaagagggcatcggtctggtgcggcggcattttaatgcgattacgccagagaacgtgacgaagtggggaccgatacacccgacgccgggcgagtataatttcgggccggccgaccggtttgttgaattcggcgaagcccatgacatgttcatgataggccatacgcttgtatggcacagccagacgccccgatgggtgttcgaggatgaagccggaaatccgctcggccgcgatgcgctcattgaacgcatgcgcgatcatatccataccgtcgtcgggcggtaccggggaaggattcacgcctgggacgttgtgaacgaagcgctgaatgaagacggaaccctgcgggaatccccatggtatcgcattataggcgaggattacctgctgaaagcctttgaattcgcgcatgaagcggatccggatgccgagctgtattataacgattattcgctcgaaaatcccgccaagcgggcgggggcggttcgcctggtccggtatctgcaggataacggtgcgccgatacacgggatcggaacccaagggcacttctctctcatctggcccgcgcttgaagagatcgataaaaccatcgtcgattttgccgcattaggcgtggacgtcatggttaccgaactcgaggtcgacgttcttcctcccgcattcgaatatcagggagccgatattgccatgcgggcggaactcgaagaacgattgaacccgtaccccgacggactgccggccgaaatcgaagatgcgcttacacagcggtatcgggacatcttcgaggtttttctgcggcacagcgacgttattacgcgtgtaacgttctggggggtggccgatggagattcatggaagaataactggccggtacagggaaggacgaactatccgctgttgttcgatcgtgaatggcagccgaaacctgcgttttattccgtgatggaagttgcggaagagatgttgaatgaataa

SEQ ID NO: 500 - protein, 384 aa, Unknown
  Obtained from environmental sample
  SIGNAL (1)...(26)
  DOMAIN (35)...(378): Glycosyl hydrolase family 10
  SITE (78)...(81): N-glycosylation site. Prosite id = PS00001
MITFRNTLFTVVILAIVGSGLPACEAAPPENADPSLHEAYADAFLMGTALNLAQIDGRDEEGIGLVRRHFNAITPENVTKWGPIHPTPGEYNFGPADRFVEFGEAHDMFMIGHTLVWHSQTPRWVFEDEAGNPLGRDALIERMRDHIHTVVGRYRGRIHAWDVVNEALNEDGTLRESPWYRIIGEDYLLKAFEFAHEADPDAELYYNDYSLENPAKRAGAVRLVRYLQDNGAPIHGIGTQGHFSLIWPALEEIDKTIVDFAALGVDVMVTELEVDVLPPAFEYQGADIAMRAELEERLNPYPDGLPAEIEDALTQRYRDIFEVFLRHSDVITRVTFWGVADGDSWKNNWPVQGRTNYPLLFDREWQPKPAFYSVMEVAEEMLNE

SEQ ID NO: 501 - DNA, 741 bp, Unknown
  Obtained from environmental sample
atgaaatatagtcatgttgtaacgctatctctagcgctggtcctatgtatcgccgggttgggtgtgtcggcagtgaacgcccaaacccactgcgggagtcaaacgggcaaccatggtggttattactttacgcactggaccgacggtggtggttccgcctgtatgaccctgggatccggcggcaactacagctattcgtggtccaacacgggtaactttgtcggcggcaagggttggagcaccggcaccaacaaccgggttatcggctataacgccggcgtctttgccccggcgggcaactcctacctggcactctatggctggaccaccaacccgctggtggaatactacgtggtggacagttggggcagctggcggccgccgggtgcgcagtctgcgggtacggtgaacagcgacggcggcacctatgatctgtacagaacccaaagggtaaaccagccttccattcagggtacggcaaccttttatcagtactggagtgtgcgcacgtcaccgcggtcccagggaaccaacaacaacattaccttccagaatcacgtcaacgcctgggcggctcgaggttggaatctgggtacgcacaactaccaggtgatggccaccgaaggttaccagagcagcggttcgtccaacgtgaccgtgtgggagtccggtaccagcggcggcggtggcggcggtggcgccagcggcggtggcggtcagaacaactcgtgccgaattctt

SEQ ID NO: 502 - protein, 247 aa, Unknown
  Obtained from environmental sample
  DOMAIN (36)...(220): Glycosyl hydrolases family 11
  SITE (62)...(65): N-glycosylation site. Prosite id = PS00001
  SITE (113)...(123): Glycosyl hydrolases family 11 active site signature 1. Prosite id = PS00776
  SITE (182)...(185): N-glycosylation site. Prosite id = PS00001
  SITE (208)...(219): Glycosyl hydrolases family 11 active site signature 2. Prosite id = PS00777
  SITE (220)...(223): N-glycosylation site. Prosite id = PS00001
  SITE (244)...(247): N-glycosylation site. Prosite id = PS00001
MKYSHVVTLSLALVLCIAGLGVSAVNAQTHCGSQTGNHGGYYFTHWTDGGGSACMTLGSGGNYSYSWSNTGNFVGGKGWSTGTNNRVIGYNAGVFAPAGNSYLALYGWTTNPLVEYYVVDSWGSWRPPGAQSAGTVNSDGGTYDLYRTQRVNQPSIQGTATFYQYWSVRTSPRSQGTNNNITFQNHVNAWAARGWNLGTHNYQVMATEGYQSSGSSNVTVWESGTSGGGGGGGASGGGGQNNSCRIL

SEQ ID NO: 503 - DNA, 1545 bp, Unknown
  Obtained from environmental sample
atgaatacaacccaaaccacaagcaaaaaaagcagtaggaaacgttttgcctacaccgcttttgtggtactcatcagcgccctgaccatatttgtatctacggctcttgctcgaactttgagcaccaatgaaaccggcacccataatggcttctactattcgttctggaaagatagcggaaatgccaccttcgaactattggaaggtggccgttacaagtctcaatggaacaacagtaccaataactgggtaggcggcaaaggttggaatccgggcggcccccggatagtcaattaccagggctattacggtgttgataactcgcaaaattcctatctggcgctctatggctggacaagaaatccgctgatcgaatactatgttatcgaaagctatggctcgtacaacccagccagttgcagtggcggccaggattatggcagttttcagagcgatggcgccacttacaatgtgcgccgttgtcagcgtgtcaatgcgccttgtatcgaagggaataactgcaccttctaccaatactttagtgtccgatcaccaaagaaaggctttggcaacatcagtggcaccatcaccgttcaaaaccactttaacttttgggcaagcaagggattgaacctgggaagccatgactatatggttttcgccaccgaaggctatcaaagcagcggtagttctgacatcacagtcagtgaaggggccatcccccccaccacgattccaccgaccggcgtgccgccaactggcgtgccaccaaccagcgtaccacctggtggccggatcgaggccgagaattatagtagctcaggcggcacggtggatgtgtgcggcggaatgctgtgctacatcggggccaatgcctggacgcaatataatagcgtgaacttgccagccgggacgaaccggatcgatctgagcgttgccaacggtggcagcaacaccagtattcaggtattgatcggcggtacgaacgtcggcaccctgaccgtgagcggcaccggcggctggaacacgttccagacccgatcgctcacattccctgcacgcagcggcacacagaatgtgcgtctcgtcttcgtcaatggcaatgtgaatgtagattggctggcgttctcaggctctggcacgaaccccaccaacacaccaccgccggtgcccaccaatacacccccagtccccccaacaacaatacctccaacgacagtacctccagcgggtggatgttcggtgagttacactcagaacagttggggcaacggggcaacggtaagtgtgagcatcgccaacaatggttcatcaaacattaatggttggacgttgggttggaccttccccggtaaccaacagattaccaatttatggagcggcacttacacccagtctggagcttccgtttcggtatcgaatgcaagctggaacggctcgattggcgctaacggcggaacgacaagttttggcttcaatatttcctttagcggttccaatcaagcgcccaccaactttaccctgaacggaaccccttgtagataa

SEQ ID NO: 504 - protein, 514 aa, Unknown
  Obtained from environmental sample
  SIGNAL (1)...(37)
  DOMAIN (46)...(235): Glycosyl hydrolases family 11
  DOMAIN (267)...(378): Carbohydrate binding module (family 6)
  DOMAIN (413)...(513): Cellulose binding domain
  SITE (2)...(5): N-glycosylation site. Prosite id = PS00001
  SITE (43)...(46): N-glycosylation site. Prosite id = PS00001
  SITE (61)...(64): N-glycosylation site. Prosite id = PS00001
  SITE (78)...(81): N-glycosylation site. Prosite id = PS00001
  SITE (175)...(178): N-glycosylation site. Prosite id = PS00001
  SITE (193)...(196): N-glycosylation site. Prosite id = PS00001
  SITE (223)...(234): Glycosyl hydrolases family 11 active site signature 2. Prosite id = PS00777
  SITE (274)...(277): N-glycosylation site. Prosite id = PS00001
  SITE (322)...(325): N-glycosylation site. Prosite id = PS00001
  SITE (441)...(444): N-glycosylation site. Prosite id = PS00001
  SITE (481)...(484): N-glycosylation site. Prosite id = PS00001
  SITE (485)...(488): N-glycosylation site. Prosite id = PS00001
  SITE (500)...(503): N-glycosylation site. Prosite id = PS00001
  SITE (512)...(515): N-glycosylation site. Prosite id = PS00001
MNTTQTTSKKSSRKRFAYTAFVVLISALTIFVSTALARTLSTNETGTHNGFYYSFWKDSGNATFELLEGGRYKSQWNNSTNNWVGGKGWNPGGPRIVNYQGYYGVDNSQNSYLALYGWTRNPLIEYYVIESYGSYNPASCSGGQDYGSFQSDGATYNVRRCQRVNAPCIEGNNCTFYQYFSVRSPKKGFGNISGTITVQNHFNFWASKGLNLGSHDYMVFATEGYQSSGSSDITVSEGAIPPTTIPPTGVPPTGVPPTSVPPGGRIEAENYSSSGGTVDVCGGMLCYIGANAWTQYNSVNLPAGTNRIDLSVANGGSNTSIQVLIGGTNVGTLTVSGTGGWNTFQTRSLTFPARSGTQNVRLVFVNGNVNVDWLAFSGSGTNPTNTPPPVPTNTPPVPPTTIPPTTVPPAGGCSVSYTQNSWGNGATVSVSIANNGSSNINGWTLGWTFPGNQQITNLWSGTYTQSGASVSVSNASWNGSIGANGGTTSFGFNISFSGSNQAPTNFTLNGTPCR

SEQ ID NO: 505 - DNA, 1059 bp, Unknown
  Obtained from environmental sample
atgcgattgaaaccaaccctgaagtgggctgtgtcactgcttgtgaccactgccgccatgacgtttacatcggcggtcaatgcccagcaacactgtgcaaacgagatcggtacccacgacggctacttcttcacccattggtctgatgggatggggtcggcctgcatgacgctcggtagcgacggtaactacagctatagctggtccgacaccggcaactttgttggcggtaaaggctgggcaactggctccagtgaccgcgttatcagctacaacgccggcacctacgcgcccgagggtaactcctacctggcgctctacggctggtccagaaaccccctgatcgaatactacgtggtcgacagctggggggactggcgtccgccgggtggcacatcggtcggcaccgtgaccagtgatggcggcacctacgatctgtacatcaccgagcgcgtggagcaaccctccatcgaaggcaccgcgaccttctatcagtactggagcgtgcgcaccagcaagcgtccgcaaggtcagaacaacaccatcaccttccggaaccatgtcgacgcctgggccaaccagggctggcacctgggtagccacgactatcaggtcatggcaacagaaggctggtatagctccggcagctccaacgtcactgtctgggaaggcggcagcggcggtagcaacggcggcggtaacggcaatgccggtggcggcggtggcgacaacaccatcgttgtacgcgcggtaggcacctcaggcaacgagcaactgcgcgtcaacgtgggcggcagcaccgttgaaaccctgagcctgtccagcagctggcaggactacaccgtcaccaccagcgcctcgggcgacgttaatgtggagctgttcaacgaccagggtgcaggctatgaagcccaggtcgaatacctcatcatcaacggcgacacccgctacggcgccgaccagagctataacaccagcgcctgggacggtgagtgcggcggcggtgaattcaccatgtggatgcactgcgatggcatcatgggatttggtgacatgtaa

SEQ ID NO: 506 - protein, 352 aa, Unknown
  Obtained from environmental sample
  SIGNAL (1)...(28)
  DOMAIN (37)...(221): Glycosyl hydrolases family 11
  SITE (63)...(66): N-glycosylation site. Prosite id = PS00001
  SITE (114)...(124): Glycosyl hydrolases family 11 active site signature 1. Prosite id = PS00776
  SITE (181)...(184): N-glycosylation site. Prosite id = PS00001
  SITE (221)...(224): N-glycosylation site. Prosite id = PS00001
MRLKPTLKWAVSLLVTTAAMTFTSAVNAQQHCANEIGTHDGYFFTHWSDGMGSACMTLGSDGNYSYSWSDTGNFVGGKGWATGSSDRVISYNAGTYAPEGNSYLALYGWSRNPLIEYYVVDSWGDWRPPGGTSVGTVTSDGGTYDLYITERVEQPSIEGTATFYQYWSVRTSKRPQGQNNTITFRNHVDAWANQGWHLGSHDYQVMATEGWYSSGSSNVTVWEGGSGGSNGGGNGNAGGGGGDNTIVVRAVGTSGNEQLRVNVGGSTVETLSLSSSWQDYTVTTSASGDVNVELFNDQGAGYEAQVEYLIINGDTRYGADQSYNTSAWDGECGGGEFTMWMHCDGIMGFGDM

SEQ ID NO: 507 - DNA, 1062 bp, Unknown
  Obtained from environmental sample
atgttaactgcaaaacgttccagaccttgggtctggtcacttctcgtgaccgcgtccgccttattgttatcggcggcagcccattcacagcaacactgttccaaccagaccggtaaccacggtggttactactttacccattggacagacggcggcggtactgcctgcatgaccctgggcgacggcggcaactacagctacacctggtccaacaccggcaactttgtcggcggcaaaggctggagtaccggcaccaataaccgggtcatcggttacaacgccggcaactactcacccgccggcaactcctacctcgccctatacggctggagcaccaatccactggtggagtactacgtggtcgatagctggggaacctggcgtccaccgggtggcacttcggtcggcacggtaaccagcgatggtggcacttatgacctctaccgcacacagcgcgtgcaacagccctccattgagggaacttccaccttctatcagtactggagtgtgcgcacctcaaagcgtcctcaagggcagaacaacaacattacctttcagaaccatgtgaacgcctgggccaatcaaggctggctcctgggcgcacacaactatcaggtaatggcggttgagggctatcagagcagtggcaacgccaatgtcaccgtctgggatgccggcagcagtggcggcggtggagacggcggcaatgccgctggcggctcaaccggctccaacacgatcgtggtgcgtgctgtgggtacttcaggcaacgagcagctgcgcgtcaatgtcggcggcaataccgtgcaaaccctgaacctgtcgagtaactggcaggattacacggtcaacaccagcgcctcgggtgatgtcaatgtcgagctgatcaacgatcagggccagggctacgaagcccgggtcgaatacctgatcatcaacggcgacacccgctacggcgccgatcagagctataacaccagcgcctgggacggcgagtgtggtggtggctccttcaccatgtggatgcactgcaacggcatcctgggctttggcaatatgtaa

SEQ ID NO: 508 - protein, 353 aa, Unknown
  Obtained from environmental sample
  SIGNAL (1)...(29)
  DOMAIN (38)...(222): Glycosyl hydrolases family 11
  SITE (35)...(38): N-glycosylation site. Prosite id = PS00001
  SITE (115)...(125): Glycosyl hydrolases family 11 active site signature 1. Prosite id = PS00776
  SITE (184)...(187): N-glycosylation site. Prosite id = PS00001
  SITE (210)...(221): Glycosyl hydrolases family 11 active site signature 2. Prosite id = PS00777
  SITE (222)...(225): N-glycosylation site. Prosite id = PS00001
  SITE (277)...(280): N-glycosylation site. Prosite id = PS00001
  SITE (288)...(291): N-glycosylation site. Prosite id = PS00001
  SITE (329)...(332): N-glycosylation site. Prosite id = PS00001
MLTAKRSRPWVWSLLVTASALLLSAAAHSQQHCSNQTGNHGGYYFTHWTDGGGTACMTLGDGGNYSYTWSNTGNFVGGKGWSTGTNNRVIGYNAGNYSPAGNSYLALYGWSTNPLVEYYVVDSWGTWRPPGGTSVGTVTSDGGTYDLYRTQRVQQPSIEGTSTFYQYWSVRTSKRPQGQNNNITFQNHVNAWANQGWLLGAHNYQVMAVEGYQSSGNANVTVWDAGSSGGGGDGGNAAGGSTGSNTIVVRAVGTSGNEQLRVNVGGNTVQTLNLSSNWQDYTVNTSASGDVNVELINDQGQGYEARVEYLIINGDTRYGADQSYNTSAWDGECGGGSFTMWMHCNGILGFGNM

SEQ ID NO: 509 - DNA, 2325 bp, Unknown
  Obtained from environmental sample
atggcgtccgccgacaatggtctacaccgctacagcgcggtggcctatgacccgtcggggaattctgcggtgtccgggacccagcgcgtgctggtggccattgacaacaaattctttggcaccgcgccgggcggcccgacgacttacgagcacctactcacctatttcaaccaactgactcccgaaaatgctggcaagtggggtagcgtagccggacagcagggggttatgaactggggtgatatcgacatcgcctaccagtttgctcgggacaacggcatacccttccgctatcacaatttggtctggggcgagcaacaacccgcctggctagattcgctcgaccaagctgaacaactgcaagccgtacacgcctggatgcagcaggtggcgcaacgctatccggacttggaagtggtggaggtggtcaatgaacccctgcacgcaccgcccagttacaaagaagccctggggggcagcggcgaaactgggtgggactgggtgatcaccgctttcgagatggcgcgggaatattttcctgcggcgcaattaaccctgaacgactatcaaattctgcatttgccccaattcacccaggaatacctggaaatcattgagttgctgcaggcgcgcaacctgctggatgccatcagcattcaggggcacttcctggagcgggcggacctggatttggtagcgatcaatctggatagcttagccgccaccgggctgcccatttacgtttccgagtttgatttgaatctcgccgatgacgcccgtcatgccaatgtttttcgggacttctttacgctgttttgggagcacccggcagtggttggcgtaacccactggggccacctggaaggcaccgtatggcaaccgaatgcctacctgatacgcaccgacggctccccccgcccagcactggaatgggccgtgtgtttcattgacggcggccaaaactgcacggtgccggactaccagcccagcggctggcaaggtgatgctttcagtttgactctggaggcagaagaatttgacacgggcgaaggtgtgctggcgctcggcggtgtggttgcttacaccgatgacggcgattggatcggctttgccgaagtggattttcaaatgggctgggacacctttgccatcacttacgccaaaggcaaccaatccggcggcagtatttccgtgcatttagacagccttgacagcagcccggtgttaaccttggagctgccaccaacacccggctggggcaccaacgaaaccctggaagtcgcctggaaccccattgtcggcacccgcgacctgtacattcgcttcaacgacgcctttggtgtggccaacgtcgatacaattcgctttgggacgccggcacccacggcaccggcactgaatttagtacaggatggcagcttcaacggtaccaccctgtcgggctggcagagttggaacaactccagcctgatgctgagcaacgcccagtcctatgatggccaccaaagcctgctggccaccaaccggcccgacagcgcccaatttgctgtgtacaacttaactggcgcagtacaagccggtgccacctacgcggttagcgcccgggtattcctggatgccgatgaaccggatactgcacgtttggccgccgtggtcgagtgtgccaacccgccggctgggcacaactcttacccctggttgcagaacctggaaggcgtagcgccacgccagtggaccgaactgtcggcggacctggtcattccagagtgcgacttggtcaacgtcgcgatctactttgagggcactggtgccggcgtggatgtgtatctggaccaagttcaagtgctcgcaccggccgcaccagacagtctgattccagacggcagttttgccaacagtacactttcaggctggcagagctggaacggttcaactttgagcttatccggtgcccaagcctacagcgggcagcaaagtttgctcgccaccaaccgacccgacacggggcagttcgccgtgtacaacctgacccaagcggtaactccgggcaccagctatcaggtgagcgctcaggcactgatcggcggcagcgaaccggacacagtacgtttggccgccaaggtggagtgtgccaacccgcccgagggccacaacagcttcccgtggctaaataacatcaacgcggtgaccccaggtgtctggacagccattgctggagaactggtcatccctgactgcgatctggttgatgtggctattttcttcgaaggcactacagcgggcaccgatgtatacctggatgaggtgcgcgtcatcgctcaataa

SEQ ID NO: 510 - protein, 774 aa, Unknown
  Obtained from environmental sample
  DOMAIN (29)...(317): Glycosyl hydrolase family 10
  DOMAIN (342)...(458): Carbohydrate binding module (family 6)
  DOMAIN (466)...(618): Carbohydrate binding domain
  DOMAIN (622)...(774): Carbohydrate binding domain
  SITE (325)...(328): N-glycosylation site. Prosite id = PS00001
  SITE (428)...(431): N-glycosylation site. Prosite id = PS00001
  SITE (482)...(485): N-glycosylation site. Prosite id = PS00001
  SITE (493)...(496): N-glycosylation site. Prosite id = PS00001
  SITE (641)...(644): N-glycosylation site. Prosite id = PS00001
  SITE (651)...(654): N-glycosylation site. Prosite id = PS00001
  SITE (685)...(688): N-glycosylation site. Prosite id = PS00001
MASADNGLHRYSAVAYDPSGNSAVSGTQRVLVAIDNKFFGTAPGGPTTYEHLLTYFNQLTPENAGKWGSVAGQQGVMNWGDIDIAYQFARDNGIPFRYHNLVWGEQQPAWLDSLDQAEQLQAVHAWMQQVAQRYPDLEVVEVVNEPLHAPPSYKEALGGSGETGWDWVITAFEMAREYFPAAQLTLNDYQILHLPQFTQEYLEIIELLQARNLLDAISIQGHFLERADLDLVAINLDSLAATGLPIYVSEFDLNLADDARHANVFRDFFTLFWEHPAVVGVTHWGHLEGTVWQPNAYLIRTDGSPRPALEWAVCFIDGGQNCTVPDYQPSGWQGDAFSLTLEAEEFDTGEGVLALGGVVAYTDDGDWIGFAEVDFQMGWDTFAITYAKGNQSGGSISVHLDSLDSSPVLTLELPPTPGWGTNETLEVAWNPIVGTRDLYIRFNDAFGVANVDTIRFGTPAPTAPALNLVQDGSFNGTTLSGWQSWNNSSLMLSNAQSYDGHQSLLATNRPDSAQFAVYNLTGAVQAGATYAVSARVFLDADEPDTARLAAVVECANPPAGHNSYPWLQNLEGVAPRQWTELSADLVIPECDLVNVAIYFEGTGAGVDVYLDQVQVLAPAAPDSLIPDGSFANSTLSGWQSWNGSTLSLSGAQAYSGQQSLLATNRPDTGQFAVYNLTQAVTPGTSYQVSAQALIGGSEPDTVRLAAKVECANPPEGHNSFPWLNNINAVTPGVWTAIAGELVIPDCDLVDVAIFFEGTTAGTDVYLDEVRVIAQ

SEQ ID NO: 511 - DNA, 1107 bp, Unknown
  Obtained from environmental sample
atgaagttcagtcatataagatcgctgtccctcgcgctggttctgtgttttaccgggtttggcgtgtcgacagttcatgctcaaacccattgcgggagccagacaggcaaccatggcggtttctactttacccactggaccgatggtggtggtagtgcctgcatgaccctgggctccggtggcaactacagctattcctggtccaataccggcaactttgttggcggcaagggctgggcaaccggcaccaataaccgggttatcggctacaacgccggggtgtttgcgccggcaggtaattcttacctggcgctctacggatggaccaccaatcctctggtggaatactacgtggtggatagctggggcagctggcggccgccgggtgcgcagtcggcaggtacagtgaacagcgatggtggcacctacgacctgtacagaacccagagagtcaaccagccctccattcagggaactgccaccttctatcagtactggagtgtgcgcacgtctccgcgtccccagggaaccaacaacaatatcaccttccagaatcacgtgaacgcctgggcgtccaggggctggaacctgggtacccataactatcaggtgatggccaccgaaggctaccagagcagcggttcttccaacgtgaccgtgtgggaatccggaaccagcggtggtggtggtggtgccaccggcggtggcggtggcggcggtggtgctaccggcggtggtggtggcggtggcggcggtggtgctaccggcggtggtggtcagcacaccatcgtggttcgcgcccgcggcgttcacggcagcgagcagatccgcctgcggatcaacaacaacaccgtggcgacctggactttgtcgaccaacatgagcaactacacctggagcggcaacaataccgggggtattgtcgtggagtttttcaacgacaacagcgttcgcgatgtgcaggttgagcacattcaggtcaacggtcagacccggcgcgcccaggatcagacctacaacacgggcgtctggcaaaacaactcctgtgggggttcccacagtcagtggctgcactgcaacggtgcgatcggatttggcaatatctag

SEQ ID NO: 512 - protein, 368 aa, Unknown
  Obtained from environmental sample
  SIGNAL (1)...(27)
  DOMAIN (36)...(220): Glycosyl hydrolases family 11
  SITE (62)...(65): N-glycosylation site. Prosite id = PS00001
  SITE (113)...(123): Glycosyl hydrolases family 11 active site signature 1. Prosite id = PS00776
  SITE (182)...(185): N-glycosylation site. Prosite id = PS00001
  SITE (208)...(219): Glycosyl hydrolases family 11 active site signature 2. Prosite id = PS00777
  SITE (220)...(223): N-glycosylation site. Prosite id = PS00001
  SITE (286)...(289): N-glycosylation site. Prosite id = PS00001
  SITE (297)...(300): N-glycosylation site. Prosite id = PS00001
  SITE (306)...(309): N-glycosylation site. Prosite id = PS00001
  SITE (351)...(354): N-glycosylation site. Prosite id = PS00001
MKFSHIRSLSLALVLCFTGFGVSTVHAQTHCGSQTGNHGGFYFTHWTDGGGSACMTLGSGGNYSYSWSNTGNFVGGKGWATGTNNRVIGYNAGVFAPAGNSYLALYGWTTNPLVEYYVVDSWGSWRPPGAQSAGTVNSDGGTYDLYRTQRVNQPSIQGTATFYQYWSVRTSPRPQGTNNNITFQNHVNAWASRGWNLGTHNYQVMATEGYQSSGSSNVTVWESGTSGGGGGATGGGGGGGGATGGGGGGGGGGATGGGGQHTIVVRARGVHGSEQIRLRINNNTVATWTLSTNMSNYTWSGNNTGGIVVEFFNDNSVRDVQVEHIQVNGQTRRAQDQTYNTGVWQNNSCGGSHSQWLHCNGAIGFGNI

SEQ ID NO: 513 - DNA, 1089 bp, Unknown
  Obtained from environmental sample
atgagatcaaaaagaatgatgtttttctttataatgctagtttcttttgcccttgcattgcctgcagtaaacgtatcagcacaaattacatcaaatgaaattggtgtccacgacggatatgactatgaattctggaaagatgaaggtggatctggaacgatgtatcttggcagtggtggtacgtttagtggggaatggaatgatatacacaatatattattccgcaaaggtcagaaatttgacgagacacaaacacatcagcaacttggaaacataactattgactacggtgctgactaccagcctaatggtagttcctatttaggggtctatggctggactagtgacccactagttgaatattatattatagatagttggggaacatggcgtccacctggtgcagatccaaaaggtacgattcatgttgatggaggaacatacgaaatatacgaaacaacgcgtgtagagcagccatctattattggtactgcaacattccaacagtattggagtgtaagaacatccaagcgtactagtggaacaatttctgttagtgagcactttaatgcttgggaaagcatggggatgccgatggggaatatgtatgaagttgccactgtagtagaaggctggcaaagtagtggatacgctgatgtctatagtaatacacttacgatcgatagttccggcggtggtggaacacctcctggagatggcggtggtggctctaccgttgtacaagctgaagatatgaacattagcggcccatgggcacaccaaatcagctctccgtttgacggtgtcgttttgtatggaaacgatgatagggtaagttacacccagtattttgcaaatgatacccatagcttttcacttcgaggggcttcgaataacaacaacttggcgagagtcgacttaagaatcggtggacaacacatggggacattttactacggggatcaccacccagcagtctataccatagataacattcagcatggcaccggccatcaggaagtggaactcatcttaactgctaatgatggtaactgggatgcttatatcgattacttagagatacattaa

SEQ ID NO: 514 - protein, 362 aa, Unknown
  Obtained from environmental sample
  SIGNAL (1)...(27)
  DOMAIN (35)...(222): Glycosyl hydrolases family 11
  SITE (24)...(27): N-glycosylation site. Prosite id = PS00001
  SITE (92)...(95): N-glycosylation site. Prosite id = PS00001
  SITE (104)...(107): N-glycosylation site. Prosite id = PS00001
  SITE (118)...(128): Glycosyl hydrolases family 11 active site signature 1. Prosite id = PS00776
  SITE (256)...(259): N-glycosylation site. Prosite id = PS00001
  SITE (290)...(293): N-glycosylation site. Prosite id = PS00001
MRSKRMMFFFIMLVSFALALPAVNVSAQITSNEIGVHDGYDYEFWKDEGGSGTMYLGSGGTFSGEWNDIHNILFRKGQKFDETQTHQQLGNITIDYGADYQPNGSSYLGVYGWTSDPLVEYYIIDSWGTWRPPGADPKGTIHVDGGTYEIYETTRVEQPSIIGTATFQQYWSVRTSKRTSGTISVSEHFNAWESMGMPMGNMYEVATVVEGWQSSGYADVYSNTLTIDSSGGGGTPPGDGGGGSTVVQAEDMNISGPWAHQISSPFDGVVLYGNDDRVSYTQYFANDTHSFSLRGASNNNNLARVDLRIGGQHMGTFYYGDHHPAVYTIDNIQHGTGHQEVELILTANDGNWDAYIDYLEIH

SEQ ID NO: 515 - DNA, 1188 bp, Unknown
  Obtained from environmental sample
atgctacatattcttcggaaaccgattatagcagggttagctttatctctcgtattctcaggtggtatggggagtgtctcagctcaagaaaatggacataaaggagtatttggaaaagatcagaaaggcaacggtaatgttcaaccgcatgcatggcaagtgtcttctcttgctgaaagatatgagagcgctttcgatattggtgctgctgtagaaccttatcaattaaacggaagacaaggtaaaattttaaagcatcattataatagtattgttgctgaaaatgcgatgaagcctatttctcttcagccccaagaaggacaatgggattgggaaggggcggacaaaattgttgagtttgctcgcaaaaatgatatgaatctacgttttcacacacttgtctggcataatcaagtaccggattggtttttccttgatgagaatggaaatccgatggtagatgaaacagatgatgagaaaagggagacaaataaagcccttttattagagcgcatgaaaacacatataaaaacggttgtagagcgttataaggatgatgtggattcttgggatgtagtaaatgaagtgatcgatgataatggaggcttacgaaattcatcttggtatcagattactggtaccgattatattaaagtagcatttgagactgctagaaaatatgctggagaagatgcaaaactttacatcaatgactacaatacggaagtaccatcaaaaagggatgacctacacaaccttgttagtcaattgttagatcaaggagttccgattgatggagtaggacatcaggcacatattcaaattgactggccttcaatagaagaaacaagagagtcttttgaaatgtttacggaactaggattggacaatcaagtaacagaactcgatgtaagtctatacggctggccgccagataacgcgtatgaaacgtatgatgatatcccagcagaagattttgagcggcaagctgttcgttacgatcagttgtttgagttatatgaagagttggaagcggacatcagcagtgtcacattctggggcatagctgataatcatacttggttggatgaccgagccgagcaatatagtggagtcggaattgatgcaccgtttttattcgacgaaaattacagagtgaaacctgcgttctggaaggtaattgattaa

SEQ ID NO: 516 - protein, 395 aa, Unknown
  Obtained from environmental sample
  SIGNAL (1)...(28)
  DOMAIN (56)...(395): Glycosyl hydrolase family 10
  SITE (208)...(211): N-glycosylation site. Prosite id = PS00001
  SITE (298)...(308): Glycosyl hydrolases family 10 active site. Prosite id = PS00591
  SITE (363)...(366): N-glycosylation site. Prosite id = PS00001
MLHILRKPIIAGLALSLVFSGGMGSVSAQENGHKGVFGKDQKGNGNVQPHAWQVSSLAERYESAFDIGAAVEPYQLNGRQGKILKHHYNSIVAENAMKPISLQPQEGQWDWEGADKIVEFARKNDMNLRFHTLVWHNQVPDWFFLDENGNPMVDETDDEKRETNKALLLERMKTHIKTVVERYKDDVDSWDVVNEVIDDNGGLRNSSWYQITGTDYIKVAFETARKYAGEDAKLYINDYNTEVPSKRDDLHNLVSQLLDQGVPIDGVGHQAHIQIDWPSIEETRESFEMFTELGLDNQVTELDVSLYGWPPDNAYETYDDIPAEDFERQAVRYDQLFELYEELEADISSVTFWGIADNHTWLDDRAEQYSGVGIDAPFLFDENYRVKPAFWKVID

SEQ ID NO: 517 - DNA, 1728 bp, Unknown
  Obtained from environmental sample
atgagtttcttcaaaaccataacgagaaacagtaaaacctgtgccgcgacattggcgttggcggcaacggtgagtgcagtttcagcaaacgctcagcaaaccctgaccgaaaacacccagactacccgcgacggcttttttgtgtccttctggaaggacagcggcagcgcctccatgacgctgtacgacaacggtcgctatacctcccagtggaacaactccaccaacaactgggtcggcggtatgggctggaaccccggaggtcgccgggtggtggaatatgagggggagtacaatgttgacaactcccagaactcctacctggcgctgtacggctggacgcgtgatccgctgattgaatactacgtgatcgaaagctatggctcctacaacccgtcgcagtgtacaacgggacgccaaacctacggcaccttccagagtgacggcgcgacttatgagatcgtccgttgtcagcgtgtgcagcagccctcgattgatggcacccagaccttctatcagtacttcagtgtgcgtcagcccaaaaaaggttttggcagcatcagcggtaccattaccgtgggcaatcactttgatgcctgggaagccgccggtttgaacctgggtaaccacgactatatggtcatggccaccgagggctaccagagcagcggtagctcggatattacggttcgggaagtcagcggtggcggcagccccggtggtccgggcacgggtggccccggtggtggcgatagctctcccggcacgggcgacaacaccctggtgattcgagcggtgggcacctcgggcagtgagcagctgcgtgtcaatgtgggcggtagtacggtgcgtacgctgagtttgtccaccagctggcaggactttaccgtcaacaccgacgccacgggcgatatcaatgtggagctgttcaacgatcagggcgagggttacgaagctcaggtcgagtatgtgcaggtcaacggcgatacccgctacgcggaagaccagagctacaacaccagtgcctgggacggcgagtgtggcggtggtagcaataccatgtggatgcactgtgatggcatgatcggctttggcgatatgaccggtggaggctctacgggtggtggcgactctggtggcagtgatggcgggtcttcgggctcgggcgataacactctggtgattcgtgctgtaggcacctccgggagtgagcagctgcgggtgaatgtgggtggtactaccatcgagaccctgagtctgtcgagcagctggcagagtttcacgatcaataccgatgccacaggcgatatcaacgttgaactgttcaacgatcagggcgaaggttacgaagcccaggttgagtacgtccaggtcaacggcgatacccgctatgcagaagaccagagctacaacaccagtgcctgggatggagagtgcggcggtggtagcaacaccatgtggatgcactgtgacggcatgatcggctttggtgatatgacaggtaacggtggtggctcaaccggcggtggtaatggcggtaacaccggtggcgattctgccggcaacaacagcggtagcgatgactgccactgcaactggtacggcagcaccatccccagttgtgccaaccagagtgaaggttggggctgggaaaataacaccagctgtgtgggcaacaatacctgcaacagtcagggtagccagcatggtggtgtggtctgtaactga

SEQ ID NO: 518 - protein, 575 aa, Unknown
  Obtained from environmental sample
  SIGNAL (1)...(31)
  DOMAIN (41)...(230): Glycosyl hydrolases family 11
  SITE (73)...(76): N-glycosylation site. Prosite id = PS00001
  SITE (118)...(128): Glycosyl hydrolases family 11 active site signature 1. Prosite id = PS00776
  SITE (218)...(229): Glycosyl hydrolases family 11 active site signature 2. Prosite id = PS00777
  SITE (344)...(347): N-glycosylation site. Prosite id = PS00001
  SITE (478)...(481): N-glycosylation site. Prosite id = PS00001
  SITE (530)...(533): N-glycosylation site. Prosite id = PS00001
  SITE (551)...(554): N-glycosylation site. Prosite id = PS00001
  SITE (560)...(563): N-glycosylation site. Prosite id = PS00001
  SITE (567)...(570): N-glycosylation site. Prosite id = PS00001
MSFFKTITRNSKTCAATLALAATVSAVSANAQQTLTENTQTTRDGFFVSFWKDSGSASMTLYDNGRYTSQWNNSTNNWVGGMGWNPGGRRVVEYEGEYNVDNSQNSYLALYGWTRDPLIEYYVIESYGSYNPSQCTTGRQTYGTFQSDGATYEIVRCQRVQQPSIDGTQTFYQYFSVRQPKKGFGSISGTITVGNHFDAWEAAGLNLGNHDYMVMATEGYQSSGSSDITVREVSGGGSPGGPGTGGPGGGDSSPGTGDNTLVIRAVGTSGSEQLRVNVGGSTVRTLSLSTSWQDFTVNTDATGDINVELFNDQGEGYEAQVEYVQVNGDTRYAEDQSYNTSAWDGECGGGSNTMWMHCDGMIGFGDMTGGGSTGGGDSGGSDGGSSGSGDNTLVIRAVGTSGSEQLRVNVGGTTIETLSLSSSWQSFTINTDATGDINVELFNDQGEGYEAQVEYVQVNGDTRYAEDQSYNTSAWDGECGGGSNTMWMHCDGMIGFGDMTGNGGGSTGGGNGGNTGGDSAGNNSGSDDCHCNWYGSTIPSCANQSEGWGWENNTSCVGNNTCNSQGSQHGGVVCN

SEQ ID NO: 519 - DNA, 1473 bp, Unknown
  Obtained from environmental sample
atgagttttgcaagcgtaaaaaatataactatcgcaggcaaagggttggtcgcgcttttcaccttcgccttactgtcaggaatttcatcggtcaatgcccagacgacgctgacgtccaatgtccagggctctgtggacggttttttctattctttctggaaggatagtggggacgcgtccatgacggtttaccccggtggtcgttacacatcgcaatggaacaactcgtccaacaactgggtgggtggtctggggtggaaccccggtggtcgcagggtggtgaattattccggtcagtacaatgtggataattcacagaactcgtatctcgcactgtacggttggacccgggatccgctggtcgaatactacgtgatcgaaagctacggttcctataacccgtccaactgcaccactggtcgccagacttacggcaccttccagagtgatggcgccacttacgagatcgttcgctgtcagcgtgtgcagcagccgtccatcgatggtactcaaaccttttatcagtacttcagtgtgcgccagccaaagctgggctttggcagcgtcagcggcaccatcaccgtgggcaatcactttgatgcctgggcttcggtggggctgaatctgggcaaccacgactatcaggtgatggcgaccgagggttatcaaagcttcggcagctccgacattactgtcagcgaaggagcaggcggcggccccggtggcggcggtcctggtgcgggtggtcccggctctggcagcaatacactggtggtgcgtgccgtgggcacatccggcagtgagcaactgcgcgtcaacgtcggcggcagctccgtggcaacgttgagtctgtccaccagttggcaggactataccgtcaataccaatgctactggcgacatcaatgtcgagctgttcaacgatcagggccagggctacgaggcacaggttgaatacgtgattgtcaacggcgacacccgctatggtgcggaccagagctacaacaccagcgcctgggacggcgagtgcggcggtggtagcttcaccatgtggatgcactgtgacggcattcttggttttggtgacatgaccggtggcggcagtggtggtgggtccaacggtggcggcggtgctccgggcggcaacaccctggtggtgcgtgctgttggcacctccggcaacgagcagttgcaggtcaatgtgggtggcaatgctgtcgagaccttgagtctgtccaccagttggcaggaatacaccatcaataccagcgcctcgggtgatgtcaatgtccagttgatcaacgaccagggtgaaggctacgaagcgcgtgtcgagtacgtcatcatcaacggtgatacccgctacggcgcggatcagagctataacaccagcgcctgggacggtgagtgtggcggcggcagcttcaccatgtggatgcactgcgaaggcatactcggttttggtgatatgtag

SEQ ID NO: 520 - protein, 490 aa, Unknown
  Obtained from environmental sample
  SIGNAL (1)...(33)
  DOMAIN (43)...(232): Glycosyl hydrolases family 11
  SITE (8)...(11): N-glycosylation site. Prosite id = PS00001
  SITE (75)...(78): N-glycosylation site. Prosite id = PS00001
  SITE (96)...(99): N-glycosylation site. Prosite id = PS00001
  SITE (120)...(130): Glycosyl hydrolases family 11 active site signature 1. Prosite id = PS00776
  SITE (138)...(141): N-glycosylation site. Prosite id = PS00001
  SITE (300)...(303): N-glycosylation site. Prosite id = PS00001
  SITE (340)...(343): N-glycosylation site. Prosite id = PS00001
  SITE (427)...(430): N-glycosylation site. Prosite id = PS00001
  SITE (469)...(472): N-glycosylation site. Prosite id = PS00001
MSFASVKNITIAGKGLVALFTFALLSGISSVNAQTTLTSNVQGSVDGFFYSFWKDSGDASMTVYPGGRYTSQWNNSSNNWVGGLGWNPGGRRVVNYSGQYNVDNSQNSYLALYGWTRDPLVEYYVIESYGSYNPSNCTTGRQTYGTFQSDGATYEIVRCQRVQQPSIDGTQTFYQYFSVRQPKLGFGSVSGTITVGNHFDAWASVGLNLGNHDYQVMATEGYQSFGSSDITVSEGAGGGPGGGGPGAGGPGSGSNTLVVRAVGTSGSEQLRVNVGGSSVATLSLSTSWQDYTVNTNATGDINVELFNDQGQGYEAQVEYVIVNGDTRYGADQSYNTSAWDGECGGGSFTMWMHCDGILGFGDMTGGGSGGGSNGGGGAPGGNTLVVRAVGTSGNEQLQVNVGGNAVETLSLSTSWQEYTINTSASGDVNVQLINDQGEGYEARVEYVIINGDTRYGADQSYNTSAWDGECGGGSFTMWMHCEGILGFGDM

SEQ ID NO: 521 - DNA, 1155 bp, Unknown
  Obtained from environmental sample
atgagcttttctcgccgcaggtttatcctgagtgccacggcaatgttagccgccacccaattgaaatcccgagccctggccgctgcggttaagacgaccggtatcaaagacgtctttgagaaagactttttcatcggtacggccatcagcaacgaagcccttcaggagcccaataccgcgctgctggctttgatcagtcgagaattcaacgccattaccgctgaaaactgcatgaagtgggaagagatccgccctcaacttgaccagtggaactgggatttagcagaccgttttgttgacttcggtctgcaaaacaagatgtacatcgtcggccacacactgatttggcatagccaagcacctgatcatatctatcttgatgcagacggcaaacgcaataatcgtctggctcagctggaggtgatggaggagcatatccagaccctcgcgggccgctataaaggtaaaatcgatgcctgggacgtggtcaatgaggcggtggaagacgatggctcctggcgagaaaccggctggtaccacaatgtcggccctgaatacatcgcgcacgccttccgtatggcggcggaggtagaccccaacgccaagctcttgtacaacgattacaacgccgctatgccgaccaagcgggaagcgattatttctgtggtaaaaggggtacaacgcgaaggcgcgcccattcatggcgtgggcatgcagggccacatgagcctgacgcaccccgacttcggcgagttcgaaaagtctatcgtggaatacgccaacctgggcgtcaaagtgcacatcacagagttggacattgacgtgttgcctttagcctgggagctgagcgcagaaatctctaaccgcttcgagtaccgcccagaaatggacccctaccgcgacggtttgcccgccgaggcagaaaaggccttggcggatcgctacgaagccttatttacaatcctgatgaaacaccgcgacaagattgagcgcgtcaccacgtggggcacgcacgacggtgagtcctggctcaacggcttccctatccctgggcgagtcaactacccgctgctattcgaccgagatatgcagcccaaagaggcctatcaccgattgctgcagctccggcagcacagacgttaccgccgtctataa

SEQ ID NO: 522 - protein, 384 aa, Unknown
  Obtained from environmental sample
  SIGNAL (1)...(28)
  DOMAIN (34)...(376): Glycosyl hydrolase family 10
  SITE (267)...(277): Glycosyl hydrolases family 10 active site. Prosite id = PS00591
MSFSRRRFILSATAMLAATQLKSRALAAAVKTTGIKDVFEKDFFIGTAISNEALQEPNTALLALISREFNAITAENCMKWEEIRPQLDQWNWDLADRFVDFGLQNKMYIVGHTLIWHSQAPDHIYLDADGKRNNRLAQLEVMEEHIQTLAGRYKGKIDAWDVVNEAVEDDGSWRETGWYHNVGPEYIAHAFRMAAEVDPNAKLLYNDYNAAMPTKREAIISVVKGVQREGAPIHGVGMQGHMSLTHPDFGEFEKSIVEYANLGVKVHITELDIDVLPLAWELSAEISNRFEYRPEMDPYRDGLPAEAEKALADRYEALFTILMKHRDKIERVTTWGTHDGESWLNGFPIPGRVNYPLLFDRDMQPKEAYHRLLQLRQHRRYRRL

SEQ ID NO: 523 - DNA, 1530 bp, Unknown
  Obtained from environmental sample
gtgaatctaaaaaataaactaacgctcaaaagctcaattgctgcagcagcatgcgttgctgcgatgagcttttcgacggcgaacgcctgtaccggcgtcctcaacaaccaaaacaacgctgtcggtactcacaacggttattattactccttctggaagcaaaccaacaacagtcgcgtgaacattacctgtggagaacccggctattataggactgactggaatggcgtattcaattgggtcggcggaatgggctggaatccaggtgggccgagaatcgttaattaccgcggcacattcaacagtggtcgcaatcggaactcgtcaaactcttatctcgcactttacgggtggactcgcgtcccaacagaagttgagtattacgtagtcgagagttacggtacctacaatcccgcaagctgcggcggtagcggcggtgttgctggcggtggcggtagtggggatggccataaaggatccgtcacgatcgacggagtacgttacaacttgacgcagtgcacacgaacgaaccagccatcgatttctggaacttccacatttaagcagtttttcagcgtacgccaagaccccctgccctggggcgaggttcaaggctccatcgacgtgggtgcccacttccaagcctgggctgatgccggcatgcaacttggcaatgatcatttttacatggtgctcgccagtgagggttatgatggtgggaataattcctctggtaactccgagctgtggataactgagggctctggcggtggtggtggtgggggcggtggtggaggtggaggtaacccacctccaccgccaccgccgagctgtggctctgtgggaggtgttcccgtttgctgtcatatcagtgcggacgataatggtgacggcatgggtatgcaagacggcgatgtgtgtaccgtcacgcaagatactgaaggctggcacccaccaaacccgtctgatgttctggcagccattaacgtaggtggtactggaccagccgtgcagattggcaacatttactacgcgcccaatacctacgtcaccggaggtacaccgaactccacgacgtccactatcagtggcagtaatagcgacgctcataggtcagagatctacggtgatttcaccgtctctgttcccatgagcaaccgacgtgtatccgttgagctcgactttgttgaattgtactggaccgagccgggccaacgctctttcaacgtgtctatcgaaggtcaaaatgttctttccaacgtggacatattcgaccaggttggcgccaacactctgtggaagcagacttttgatgtgaacgtgaccggtggtcaactggacatcgatatcactaccaacagtgacaatggaaccttgagcgcgatccttgtgcggccatctaccggcagccccagttcttcaagctcttcgagcagttcttcaagctcttccagcagttcacccaccgccccgagcagctcaccttcgagttcatcttccggtggtggtaatccgccgccgcctgcgacc

SEQ ID NO: 524 - protein, 510 aa, Unknown
  Obtained from environmental sample
  SIGNAL (1)...(29)
  DOMAIN (42)...(251): Glycosyl hydrolases family 11
  SITE (56)...(59): N-glycosylation site. Prosite id = PS00001
  SITE (61)...(64): N-glycosylation site. Prosite id = PS00001
  SITE (108)...(111): N-glycosylation site. Prosite id = PS00001
  SITE (171)...(174): N-glycosylation site. Prosite id = PS00001
  SITE (244)...(247): N-glycosylation site. Prosite id = PS00001
  SITE (361)...(364): N-glycosylation site. Prosite id = PS00001
  SITE (415)...(418): N-glycosylation site. Prosite id = PS00001
  SITE (446)...(449): N-glycosylation site. Prosite id = PS00001
  SITE (463)...(466): N-glycosylation site. Prosite id = PS00001
MNLKNKLTLKSSIAAAACVAAMSFSTANACTGVLNNQNNAVGTHNGYYYSFWKQTNNSRVNITCGEPGYYRTDWNGVFNWVGGMGWNPGGPRIVNYRGTFNSGRNRNSSNSYLALYGWTRVPTEVEYYVVESYGTYNPASCGGSGGVAGGGGSGDGHKGSVTIDGVRYNLTQCTRTNQPSISGTSTFKQFFSVRQDPLPWGEVQGSIDVGAHFQAWADAGMQLGNDHFYMVLASEGYDGGNNSSGNSELWITEGSGGGGGGGGGGGGGNPPPPPPPSCGSVGGVPVCCHISADDNGDGMGMQDGDVCTVTQDTEGWHPPNPSDVLAAINVGGTGPAVQIGNIYYAPNTYVTGGTPNSTTSTISGSNSDAHRSEIYGDFTVSVPMSNRRVSVELDFVELYWTEPGQRSFNVSIEGQNVLSNVDIFDQVGANTLWKQTFDVNVTGGQLDIDITTNSDNGTLSAILVRPSTGSPSSSSSSSSSSSSSSSSPTAPSSSPSSSSSGGGNPPPPAT

SEQ ID NO: 525 - DNA, 3048 bp, Unknown
  Obtained from environmental sample
atgaataacagcaaggacttcttttacaaagcccgcggatttctgtcggcactgttgcttttagtgccgatagccgcacacgccaataacaatccgctcatttctcatgtctacaccgccgacccggcggcgcgcgtgatcgacgaccgggtctacgttctggtcacccacgaccaggaaggccagaccggttacggtgaactgcacgactactacctgttttcctccgatgacatggtcaactggcaggatcacggtgttgtctggaactccagaaccgataccacctgggcaaacctggcgtttgcgcccgactttatcgagcgcaacggacgctactatctgtacttccccgatggcggcaactccattggggtcgcggtagccgatcagccggaagggccttacaccgaccccctcgggcacccgttggtggaccgcaacacccccaacgccaacgtcgactgggtgtttgatccgggtgtgtttatcgacgacgacggccgcgcctacctttactttggcggcggcggccccggcactgcccgggtgatcgagctcaacaacgacatgatcagcaccaatggcgcggccattaccctggacgtgccggactttttcgaagcgctgtacatgaacaagcgcaacggcatctattacctgagctattccaccaacccggatgcgggcatgcacatcgactacatgaccagcgataaccccaccagcgggttccagcatcgcggcaccattctgcccaacccctgggagaacaacttcaacaacaatcaccagtcgatggtggagtacgagggccagtggtacatcttctaccacaaccgggcggtgtccaatgagcgcagcggcaatacctacgagcgctcgatcaatgccgatcgggtctattttggcgctgacggcgcgattctccccgtcgatgccggccccgccggcgtgccccaactgcgctacgtcgatgcctttgcccagaacccggcagcgtctttttccggcgagagcggcattcagaccgagccttccagtgagggcggtcagaacctgatgatgggtgccggcaactgggtgcggatttccggtgtcgactttggcgacggtgccacaggcatgaatgcgcgcctggcagcggatatcgattccggcctcgagatctatctcaacgacatcgacagtcaacccatcgcgaccctgaatgtcagtaacaccggtggctggcagacctgggagacccagtccgtctccttcgaccaagtgagcggcgtgcacgatgtttacctgcgctcgaccgccggccacaacctgaactggtaccagtttaccggtgcgggcaacggcgactcgtccagcagctcgagcagctcatccgagccggaccagagcggcaacgtcaccggcagtatccatgtcgacaaccagtggagcgatggttattgcgccacgctgacggtcaccaacaacaccgatgcggccctgacctggcagctggatatcaccgttgagggcaccgtgaccagcctgtggaacggcgagtggagtcaatcgggctcgaccctgcaagtctccggtgtggcctggaacagcaccctgggcgccggacagagcgacgccagtatcggcttctgcgccgagtccgccaatccgccgggttcgtccagctcgtcgagttcttccagttcgtccagcagcagctccagcagtacgccggacaatggcgaagagctggcccgtaacggcagccttaccgatggcctcacccactggtccaccactgccggggagattgccctgagcacccaggtataccgcagcggtaatgccagcgcccagatcaccggacgcacggacacctggcacgggctcacctttgctccggcatccctggctcaagggggcgactacgccgtctcggtctgggtgcgcctggctgccggtagcccggacaccactctttacctgaccgccaagcgcgaggacgacggtgacccggacagctttgccgagtacagccgggtggcagaggtcagcgccaacgccaacagctgggtggaactcagcggcagctacacccagagcggcacgcccttcgagcactttattatcgaatccgagagcgccacggtgagcttttacgccgatgacttttcggtggtgggcgccgctggcggcggcaccgggtgggacgctatcgatcaccccttctttgtgggtaacatcaccaccctgggcgcggtacgcccggactttgtggactactgggatcagatcaccccggagaatgaaggcaagtggggcagcgtcgagggcacccgcggcgtctacaactgggccggactggatgcggcctaccagtacgcgcaggaacagggtattccgttcaagcagcacaccctgatctggggcagtcagtaccccgcctggattgattcactcagcccggcggaacaggccgaggccattgaaggctggattcaggcctactgcgagcgctacccgaataccgacatcatcgatgtggtcaacgagtcgacgccgggacatgcccccgccggctatgcggaaagtgccttcggcagcgactggatcattcgcatgtttgagctgacccgccagtattgccccgactcaatcctggtgctgaacgactacaacgtgctcagctgggataacgaggcctttatcgaaatggcgcgcccggcggtggaagccggcgtggtggacgccctgggcctgcaggcgcacggactggaaaactggtcgctgagcgagatcagcgccaacctggaccgggtggcggccctgggcctgccgatttacatctcggagtatgacattgccgagaccaacgatcaggcccagctgcagatcatgcagacccagttcccgctgttctacgaacacccctcggtggtgggcatcaccctgtggggctatgtggtggatcagacctggctggaaggcagtggcctgatgtacccggacggcaccccccgcccggccatgacctggctgatgaactacctgggccgctaa

SEQ ID NO: 526 - protein, 1015 aa, Unknown
  Obtained from environmental sample
  SIGNAL (1)...(28)
  DOMAIN (29)...(309): Glycosyl hydrolases family 43
  DOMAIN (332)...(447): Carbohydrate binding module (family 6)
  DOMAIN (469)...(566): Cellulose binding domain
  DOMAIN (578)...(725): Carbohydrate binding domain
  DOMAIN (711)...(1013): Glycosyl hydrolase family 10
  SITE (2)...(5): N-glycosylation site. Prosite id = PS00001
  SITE (410)...(413): N-glycosylation site. Prosite id = PS00001
  SITE (475)...(478): N-glycosylation site. Prosite id = PS00001
  SITE (498)...(501): N-glycosylation site. Prosite id = PS00001
  SITE (540)...(543): N-glycosylation site. Prosite id = PS00001
  SITE (591)...(594): N-glycosylation site. Prosite id = PS00001
  SITE (620)...(623): N-glycosylation site. Prosite id = PS00001
  SITE (754)...(757): N-glycosylation site. Prosite id = PS00001
  SITE (859)...(862): N-glycosylation site. Prosite id = PS00001
  SITE (894)...(908): Trp-Asp (WD) repeats signature. Prosite id = PS00678
  SITE (937)...(940): N-glycosylation site. Prosite id = PS00001
  SITE (954)...(964): Glycosyl hydrolases family 10 active site. Prosite id = PS00591
MNNSKDFFYKARGFLSALLLLVPIAAHANNNPLISHVYTADPAARVIDDRVYVLVTHDQEGQTGYGELHDYYLFSSDDMVNWQDHGVVWNSRTDTTWANLAFAPDFIERNGRYYLYFPDGGNSIGVAVADQPEGPYTDPLGHPLVDRNTPNANVDWVFDPGVFIDDDGRAYLYFGGGGPGTARVIELNNDMISTNGAAITLDVPDFFEALYMNKRNGIYYLSYSTNPDAGMHIDYMTSDNPTSGFQHRGTILPNPWENNFNNNHQSMVEYEGQWYIFYHNRAVSNERSGNTYERSINADRVYFGADGAILPVDAGPAGVPQLRYVDAFAQNPAASFSGESGIQTEPSSEGGQNLMMGAGNWVRISGVDFGDGATGMNARLAADIDSGLEIYLNDIDSQPIATLNVSNTGGWQTWETQSVSFDQVSGVHDVYLRSTAGHNLNWYQFTGAGNGDSSSSSSSSSEPDQSGNVTGSIHVDNQWSDGYCATLTVTNNTDAALTWQLDITVEGTVTSLWNGEWSQSGSTLQVSGVAWNSTLGAGQSDASIGFCAESANPPGSSSSSSSSSSSSSSSSSTPDNGEELARNGSLTDGLTHWSTTAGEIALSTQVYRSGNASAQITGRTDTWHGLTFAPASLAQGGDYAVSVWVRLAAGSPDTTLYLTAKREDDGDPDSFAEYSRVAEVSANANSWVELSGSYTQSGTPFEHFIIESESATVSFYADDFSVVGAAGGGTGWDAIDHPFFVGNITTLGAVRPDFVDYWDQITPENEGKWGSVEGTRGVYNWAGLDAAYQYAQEQGIPFKQHTLIWGSQYPAWIDSLSPAEQAEAIEGWIQAYCERYPNTDIIDVVNESTPGHAPAGYAESAFGSDWIIRMFELTRQYCPDSILVLNDYNVLSWDNEAFIEMARPAVEAGVVDALGLQAHGLENWSLSEISANLDRVAALGLPIYISEYDIAETNDQAQLQIMQTQFPLFYEHPSVVGITLWGYVVDQTWLEGSGLMYPDGTPRPAMTWLMNYLGR

SEQ ID NO: 527 - DNA, 1140 bp, Unknown
  Obtained from environmental sample
atgactgctatttcccgccgcaaattcctgctcagttccgctggcgccctggcgctggcccagatgaaggtttccgccattgccaaggccctggacgacaccgggctcaaggacgcctacaagaacgactttctgatcggcaccgccatcagcaacggcactctggcgaacaatgacacggcgctactgagtctgatcagccgggagttcaatgccatcactgcagaaaactgcatgaaatccggcctgattcaaccctcccaggggcagtgggagtggcagctggccgaccgctttatcgactttggcaccgagaacaacatgaccattgtcggccacgctctggtctggcactcacaggcgccgggggatttcttctccaaccccgacggcagccgtatctcccgggatgaactggtcaagcggatggatactcatatctccacgttaatggagcgctacaaggggcgtgttcacatttgggatgtggtcaacgaggccattgatgaggaccggggctggcgccggagccccttcttcgaaatcatggggccggagtacatggagtacgccttccatctggctcacgagctggaccccaccgcgcacctgatttacaacgactacaacatgcacgacccggccaagcgggagtttctccagaacatcatcaaggattaccgcaaccgcggagtacccatccacggggttggcctgcaaggccacgtggggctggactggccggatctggaagaattcgaaaagagtatcgtcactcacgccgcagaaggtatgcggatccatgtgacagagatggacgtggacgtgctgccggtggcctgggagtacatgggcgcggagatctccaccgagttcgagtactcggaccagctcaacccatggagcgaaaaactgcccgcagaaatcgaggagaaactcaccgcccgctacgtggagctgttccgtctcttcctgaaacaccgggacaagatcgaccgcatcaccacctggggtacgcacgatggcgaatcctggaaaaacgatttcccggtacgcggccgcaccaactacccgctgctgttcgatcgcgacctgcagcccaagcccgcccacagggccctgctgggcctgcccggctga

SEQ ID NO: 528 - protein, 379 aa, Unknown
  Obtained from environmental sample
  SIGNAL (1)...(30)
  DOMAIN (35)...(378): Glycosyl hydrolase family 10
  SITE (52)...(55): N-glycosylation site. Prosite id = PS00001
  SITE (58)...(61): N-glycosylation site. Prosite id = PS00001
  SITE (108)...(111): N-glycosylation site. Prosite id = PS00001
MTAISRRKFLLSSAGALALAQMKVSAIAKALDDTGLKDAYKNDFLIGTAISNGTLANNDTALLSLISREFNAITAENCMKSGLIQPSQGQWEWQLADRFIDFGTENNMTIVGHALVWHSQAPGDFFSNPDGSRISRDELVKRMDTHISTLMERYKGRVHIWDVVNEAIDEDRGWRRSPFFEIMGPEYMEYAFHLAHELDPTAHLIYNDYNMHDPAKREFLQNIIKDYRNRGVPIHGVGLQGHVGLDWPDLEEFEKSIVTHAAEGMRIHVTEMDVDVLPVAWEYMGAEISTEFEYSDQLNPWSEKLPAEIEEKLTARYVELFRLFLKHRDKIDRITTWGTHDGESWKNDFPVRGRTNYPLLFDRDLQPKPAHRALLGLPG

SEQ ID NO: 529 - DNA, 696 bp, Unknown
  Obtained from environmental sample
atgaaacacaacgtgttctctacccgcgcgcttcggcgcgttctccctggtggtctgctcatcgcaggcctgatcggcgccacggccactggcctccaggcgcaaagcatcacttccaatcaacaaggtacccacagtgggtatttctatacctattggaaggattccggaaacgtgacgatgaatctcggttccggcggaaactactccgttaactggagcttgccttccaatggcaacttcgttggcggtaaaggctgggcgaccggcacttccaatcgtcgtatcggctacaatgccggggtctggaacccgaatggcaacggctatctcaccctctacggatggaccaccagcccgctggtggaatactacgtggtggacagttggggcagctggcgcccgcccggtggctcctcccagggcacggtcaacagtgacggtggtacctacgacctgtatcggacccagcgggtcaaccagccttcgattcagggaacggcgaccttctaccaatactggagcgtgcgcactgccaagcgcccgactggaagcaatcaggtcatcaccttcagcaatcacgtcaatgcttggcgtaatcgcggctggaacctcggcaatcataactatcaggttatggcgaccgaagggtatggcagcagcggttcctccaacttgacggtgtggcaacagtaa

SEQ ID NO: 530 - protein, 231 aa, Unknown
  Obtained from environmental sample
  SIGNAL (1)...(34)
  DOMAIN (43)...(228): Glycosyl hydrolases family 11
  SITE (58)...(61): N-glycosylation site. Prosite id = PS00001
  SITE (69)...(72): N-glycosylation site. Prosite id = PS00001
  SITE (73)...(76): N-glycosylation site. Prosite id = PS00001
  SITE (121)...(131): Glycosyl hydrolases family 11 active site signature 1. Prosite id = PS00776
  SITE (216)...(227): Glycosyl hydrolases family 11 active site signature 2. Prosite id = PS00777
  SITE (228)...(231): N-glycosylation site. Prosite id = PS00001
MKHNVFSTRALRRVLPGGLLIAGLIGATATGLQAQSITSNQQGTHSGYFYTYWKDSGNVTMNLGSGGNYSVNWSLPSNGNFVGGKGWATGTSNRRIGYNAGVWNPNGNGYLTLYGWTTSPLVEYYVVDSWGSWRPPGGSSQGTVNSDGGTYDLYRTQRVNQPSIQGTATFYQYWSVRTAKRPTGSNQVITFSNHVNAWRNRGWNLGNHNYQVMATEGYGSSGSSNLTVWQQ

SEQ ID NO: 531 - DNA, 1548 bp, Unknown
  Obtained from environmental sample
gtgaaattaacaaataaaataacgcttaaaggctcgcttgcagcagctgcgtgtgttgctgccatgggcttttccacagcgaacgcgtgtaccggcgcgctcaacaatcagaacaacgcaataggcacgcacaacggcttctattattcgttttggaagcagttcgatggcaatagagtgaatattacctgcggagaacccggctattataggaccgaatggagcaacgtctttaactgggttggtggattgggctggaatccaggtgggccgagaatcgttaattaccaaggcacattcaacagtggccgcgcccggaactcatcaaactcttatcttgcgctttacggttggactcgagttccgaatgaagttgagtattacgtcgtcgagagttacggctcctacaatcccgcaagctgcggcggtagcggcggtgttgctggcggtggcggtagtggagatggccataagggctccgtcacaatcggcggagtggtttacgacttgacgcaatgcacacgaacgaaccagccatctatttctggaacgtccacatttaggcagttttttagtgtacgccgagaccccctgccctggggtcagatccaaggttccatcgacgtgggggctcatttccaagcctgggctgacgctggcatgcagcttggcactgatcatttctacatggtgctcgccactgagggttacgatggcaatagcaactcctctggtaactcagagctgtggataagtgagggcgccggcggtggcggcactccgccgccaccaagctgcggctctgtgggtggtgttccggtttgctgtcacatcagcgccgacgagaatggcgacggtatgggcatgcagaacggcgatgtatgtaccgttacgcaagacaccgaaggctggcatccaccaaacccgtctgacatcctggcggcgattaacgtaggcggtaccggtcctgcggtgcagttcaacaacgtttactacgcacctaatacctatgtcagcgatggcttgccacactccacaaccgcctccatcagcggcggtaatagtgagatttatcaaacggaaatgtacggcgatatcagcatctcgattcccatggccaatcagcgcgtaaccgttgaactgggctttgtagaaatgtattgggaagagccgggccagcgttccttcaacgtggcgctccagggccaaaacgttctgtccaacgttgacatatactctgaggtaggcgccaacactctgtacgcgccgacttttgacgtggacgtaactggcggtcgactgaacattgacatcaccactattagcgacaatggcaccttgagcgcagttctcgtgcgcccgtatacgccttcaccagagccttcaccagagccacagccatctccggaaccacaaccatctccggagccgcaaccatctccggaaccgcaaccgtcacaagaaccgcaacctcagccatcaccggagcaaccacctgtgagcgccggcggtggcatggggcattggttcctgatgttccctcgtgcc

SEQ ID NO: 532 - protein, 516 aa, Unknown
  Obtained from environmental sample
  SIGNAL (1)...(29)
  DOMAIN (42)...(247): Glycosyl hydrolases family 11
  SITE (61)...(64): N-glycosylation site. Prosite id = PS00001
  SITE (108)...(111): N-glycosylation site. Prosite id = PS00001
  SITE (245)...(248): N-glycosylation site. Prosite id = PS00001
  SITE (450)...(453): N-glycosylation site. Prosite id = PS00001
MKLTNKITLKGSLAAAACVAAMGFSTANACTGALNNQNNAIGTHNGFYYSFWKQFDGNRVNITCGEPGYYRTEWSNVFNWVGGLGWNPGGPRIVNYQGTFNSGRARNSSNSYLALYGWTRVPNEVEYYVVESYGSYNPASCGGSGGVAGGGGSGDGHKGSVTIGGVVYDLTQCTRTNQPSISGTSTFRQFFSVRRDPLPWGQIQGSIDVGAHFQAWADAGMQLGTDHFYMVLATEGYDGNSNSSGNSELWISEGAGGGGTPPPPSCGSVGGVPVCCHISADENGDGMGMQNGDVCTVTQDTEGWHPPNPSDILAAINVGGTGPAVQFNNVYYAPNTYVSDGLPHSTTASISGGNSEIYQTEMYGDISISIPMANQRVTVELGFVEMYWEEPGQRSFNVALQGQNVLSNVDIYSEVGANTLYAPTFDVDVTGGRLNIDITTISDNGTLSAVLVRPYTPSPEPSPEPQPSPEPQPSPEPQPSPEPQPSQEPQPQPSPEQPPVSAGGGMGHWFLMFPRA

SEQ ID NO: 533 - DNA, 1359 bp, Unknown
  Obtained from environmental sample
agctcgtcgagcagcagctccagcagtgcgccggacaatggcgaggagctggcgcgcaatggcagcctcaccgatggcctcacccactggtcgatcactgccggggagattgccctgagcacccaggtacgtcgcagcggtaatgccagcgcccagatcaccggacgcacgagcacctggcatgggctcacttttgcccccgcgtccctggcccaagggggcgaatacgcggtctcggtctgggtacgcctggctgccggcagtccggcgaccaccctttacctgaccgccaagcgcgaggacgacggtgacccggacagctttgccgagtacagccgggtggcagaggtcagcgccaacgccaacagttgggtagcactcagcggcagctacacccagagcggcacgcccttcgagcactttattatcgaatccgagagcgccacggtgagcttttacgccgatgacttttcggtggtgggcgccgctggcggcggcaccgggtgggacgctatcgatcatcccttctttgtcggcaacatcaccactctgggcgcggtacgcccagactttgtgacctactgggaccagatcaccccggagaatgaaggcaagtggggcagcgtcgagggcacccgcggcgtctacaactgggccggactggatgctgcctaccagtacgcccaggaacagggtattccgttcaaacagcacaccctgatctggggcagccagtaccccgcctggattgattcactcagcccggcggaacaggccgaggccattgaaggctggattcaggcctactgcgagcgctacccgaataccgacatcatcgatgtggtcaacgagtcgacgccgggacacgcccccgccggctatgcggaaagtgccttcggcagcgactggatcattcgcatgtttgagctgacccgccagtattgccccgactcaatcctggtgctgaacgactacaatgtgctcagctgggataaccaggcctttatcgacatggcgcgcccggcggtggaagccggcgtggtggacgccctgggcctgcaggcgcacggactggaaaactggtcgctgagcgagatcagcgccaacctggaccgggtcgcggccctgggcctgccgatttacatctcggagtatgacattgccgagaccaacgatcaggcccagctgcagatcatgcagacccagttcccgctgttctatgaacacccttcggtggtgggcatcaccctgtggggctatgtggtggatcagacctggctggaaggcagtggcctgatgtacccggacggcaccccccgcccggccatgacctggctgatgaactacctgggccgctaa

SEQ ID NO: 534 - protein, 452 aa, Unknown
  Obtained from environmental sample
  DOMAIN (15)...(162): Carbohydrate binding domain
  DOMAIN (148)...(450): Glycosyl hydrolase family 10
  SITE (20)...(23): N-glycosylation site. Prosite id = PS00001
  SITE (48)...(51): N-glycosylation site. Prosite id = PS00001
  SITE (182)...(185): N-glycosylation site. Prosite id = PS00001
  SITE (287)...(290): N-glycosylation site. Prosite id = PS00001
  SITE (365)...(368): N-glycosylation site. Prosite id = PS00001
  SITE (382)...(392): Glycosyl hydrolases family 10 active site. Prosite id = PS00591
SSSSSSSSSAPDNGEELARNGSLTDGLTHWSITAGEIALSTQVRRSGNASAQITGRTSTWHGLTFAPASLAQGGEYAVSVWVRLAAGSPATTLYLTAKREDDGDPDSFAEYSRVAEVSANANSWVALSGSYTQSGTPFEHFIIESESATVSFYADDFSVVGAAGGGTGWDAIDHPFFVGNITTLGAVRPDFVTYWDQITPENEGKWGSVEGTRGVYNWAGLDAAYQYAQEQGIPFKQHTLIWGSQYPAWIDSLSPAEQAEAIEGWIQAYCERYPNTDIIDVVNESTPGHAPAGYAESAFGSDWIIRMFELTRQYCPDSILVLNDYNVLSWDNQAFIDMARPAVEAGVVDALGLQAHGLENWSLSEISANLDRVAALGLPIYISEYDIAETNDQAQLQIMQTQFPLFYEHPSVVGITLWGYVVDQTWLEGSGLMYPDGTPRPAMTWLMNYLGR

SEQ ID NO: 535 - DNA, 1002 bp, Unknown
  Obtained from environmental sample
atggataataatacaaacaccccatcattgtttgaggtatatgaaaaatattttccaattggggctgcagtgaatccaacaacacttaattctgatcaagagttgctaaagaaacactttaaaagtattacagctgaaaatgaaatgaagtttgaaagattacagcctaaagaaaatgaatttacttttgagaaggcagatgaaatgtttgcattcgcagaagctaatgaaaaaattgtacgtggacatacacttgtttggcacaaccaaacacctgactgggtttttgaaaatgaagacggctctcaggttagtgaggaaaaactactagaaagaatggaaaaccacattacaactgttatgagtcgatataaagggcgaatttacagctgggatgtggttaatgaagttatatcagatcatgaaggtgaatttttaagacaatctaaatggttggatattctaggagaagattttattgcaaaggcatttgaaatcgctcacaaagtagatccagaagctaaattattctataacgactataatgagtcgaatccggaaaaaagagaaaagatttataaattagttaaatctcttgttgataaaggcgttccaattcatggtgtagggttacaagctcactggaatttatatcaacctagtattgaagatgtaagagtggcaattgaacgttacgcatctctagggttagaactgcaagttacagaattagatgtatctgtttttgactgggaagacaaaaggacagatttgacggaaccgacacaagaaatgttggagcttcaagcacaacgttatgatgaattttttaagttgcttagagaatatcatgaagtcattacaagtgtaacgttctggggtgtgagtgacaaatacacttggttaagtaattttccagttcagggaagaaaaaattggccttttgtttttgatgagaatcagaagccaaaagattctttttggaagcttgtaaacttatag

SEQ ID NO: 536 - protein, 333 aa, Unknown
  Obtained from environmental sample
  DOMAIN (9)...(333): Glycosyl hydrolase family 10
  SITE (3)...(6): N-glycosylation site. Prosite id = PS00001
  SITE (184)...(187): N-glycosylation site. Prosite id = PS00001
  SITE (239)...(249): Glycosyl hydrolases family 10 active site. Prosite id = PS00591
MDNNTNTPSLFEVYEKYFPIGAAVNPTTLNSDQELLKKHFKSITAENEMKFERLQPKENEFTFEKADEMFAFAEANEKIVRGHTLVWHNQTPDWVFENEDGSQVSEEKLLERMENHITTVMSRYKGRIYSWDVVNEVISDHEGEFLRQSKWLDILGEDFIAKAFEIAHKVDPEAKLFYNDYNESNPEKREKIYKLVKSLVDKGVPIHGVGLQAHWNLYQPSIEDVRVAIERYASLGLELQVTELDVSVFDWEDKRTDLTEPTQEMLELQAQRYDEFFKLLREYHEVITSVTFWGVSDKYTWLSNFPVQGRKNWPFVFDENQKPKDSFWKLVNL

SEQ ID NO: 537 - DNA, 1137 bp, Unknown
  Obtained from environmental sample
atgccatcccgtcgtcagtttttactcggttcagcgcaggtcacaggcctgatgatgctcgccaagcatcaagctatcgcgagcgccgctcaaaaaaccggtcttgccgaagtttacaaagacaacttctatataggcacggccatatcaaccggcactttgctcaataacaatgaggccatgcttaatttgatcgcccgcgaatttaatgccattacggctgagaattgcatgaaatggggggtgctcaatcccgagccgggtgtttggttgtgggatgcggcggatcgtatgatgagctatggtgaacagcacgacatgtgtatcgtgggccattgtctggtgtggcattcacaggttccgggttggttgttcagggatgataagggggggcaggtcagtgcagacgagctcaagcgtcgcatggagagccatattcaaaccctggcgggccgctacaaaggcaaaattcatatttgggatgtggtcaatgaagcgattgatgaggacaagggatggcgtaagagtccttggttcaatattctcggccccgaatttatggagcgggccttccatctggcccatgaagtggatccagacagccatctgatttacaacgattacaatatgcacaaccccggcaagcgtaagtttctgttcaacgtgcttgaggattacgttaagcgtggtgtgcctattcatggtgtgggaatgcagggccatgtggggttggactatccggacatgaccgagtttgaaaataccatgaaggcttgtgctgatctgggtcttgccttgcacatcaccgaattggatgtggatgtactgccggtggcctgggagcatatgggggcggaaatctccacgaactttgcctacagtgacgagcttaacccctatgtggatggtttgcccgacaaagtgcagcaacagttgaccgaccgctatgtgcagcttttcgagctgttcctcaagtatgaaaaacacatcgcccgtgtatctacctggggaactaccgacggtgagagctggaaaaataacttcccggtacgcggacgcaccaactatccgctgttatttgatcgcgagggtaaagccaagccggcctatcacgccatcaaggcactcaagtcctga

SEQ ID NO: 538 - protein, 378 aa, Unknown
  Obtained from environmental sample
  SIGNAL (1)...(29)
  DOMAIN (34)...(377): Glycosyl hydrolase family 10
  SITE (267)...(277): Glycosyl hydrolases family 10 active site. Prosite id = PS00591
MPSRRQFLLGSAQVTGLMMLAKHQAIASAAQKTGLAEVYKDNFYIGTAISTGTLLNNNEAMLNLIAREFNAITAENCMKWGVLNPEPGVWLWDAADRMMSYGEQHDMCIVGHCLVWHSQVPGWLFRDDKGGQVSADELKRRMESHIQTLAGRYKGKIHIWDVVNEAIDEDKGWRKSPWFNILGPEFMERAFHLAHEVDPDSHLIYNDYNMHNPGKRKFLFNVLEDYVKRGVPIHGVGMQGHVGLDYPDMTEFENTMKACADLGLALHITELDVDVLPVAWEHMGAEISTNFAYSDELNPYVDGLPDKVQQQLTDRYVQLFELFLKYEKHIARVSTWGTTDGESWKNNFPVRGRTNYPLLFDREGKAKPAYHAIKALKS

SEQ ID NO: 539 - DNA, 1092 bp, Unknown
  Obtained from environmental sample
atgaaaacattacttaaaataacattaagtacactgtttgcttttatcgttttaatgggctgtgatatgggactcagagatgcagatgctgcatccgatggagccgctgcccgacaggtgaccgagaatcagcaaggaaaccacgacggatatttcttttcgttctggaccgacgcccccgggacggtttcgatgcagcaggggcctggtggaaactacagcaccagctggacagacaccggcaactttgttataggcaaaggatggagcacgggtagtcgacgcagtgttgactacacagcaacctttaatccttcggggaatgcctatctgaccctgtatggctggactaccgatccgctggtcgagtactacataatcgagaactggggaacctatcgacccgatggtgattataagggaacagtgtattctgacggtgcaacatatgacatctatgaaacgacacgctatcaacaaccctcgatccagggcactcaaacattccagcaatactggagcgttcgccagtcgcgtcgatcaagtggtactatcactgccggcaaccactttgatgcctgggaaagccacggcatgcctttgggaaatcatgactacatgatcatggctaccgaggggtaccagagcagtgggaattccaatgtgaccatcggtactaccggcgacggtggtggtggaaacggcggcagtggtggcaatggaggcagcagtggcgccatagacctgaattcctggcaggcagatggacagcatgaaaacctgaatgtctggggcggcgctgtcggcggttggtcaaacggtgactggattcgttttgacaacgttgatgtgtccggcaaaaccaacctcaacttcaacctggccaccactatcaacggtactttccgggttgtaatgggtaactatcatggtaccgaaattggccgactcgactactccccgaccggcggctggaacaactataacaaccagtcagtaaacctgaatctgaatggtgccaccggcaatcagagcatctatatcattgcttctggaggtgccgccaatctcggtacactgacaatgcagtaa

SEQ ID NO: 540 - protein, 363 aa, Unknown
  Obtained from environmental sample
  SIGNAL (1)...(28)
  DOMAIN (46)...(224): Glycosyl hydrolases family 11
  DOMAIN (215)...(362): Carbohydrate binding module (family 6)
  SITE (73)...(76): N-glycosylation site. Prosite id = PS00001
  SITE (121)...(131): Glycosyl hydrolases family 11 active site signature 1. Prosite id = PS00776
  SITE (212)...(223): Glycosyl hydrolases family 11 active site signature 2. Prosite id = PS00777
  SITE (224)...(227): N-glycosylation site. Prosite id = PS00001
  SITE (303)...(306): N-glycosylation site. Prosite id = PS00001
  SITE (335)...(338): N-glycosylation site. Prosite id = PS00001
  SITE (348)...(351): N-glycosylation site. Prosite id = PS00001
MKTLLKITLSTLFAFIVLMGCDMGLRDADAASDGAAARQVTENQQGNHDGYFFSFWTDAPGTVSMQQGPGGNYSTSWTDTGNFVIGKGWSTGSRRSVDYTATFNPSGNAYLTLYGWTTDPLVEYYIIENWGTYRPDGDYKGTVYSDGATYDIYETTRYQQPSIQGTQTFQQYWSVRQSRRSSGTITAGNHFDAWESHGMPLGNHDYMIMATEGYQSSGNSNVTIGTTGDGGGGNGGSGGNGGSSGAIDLNSWQADGQHENLNVWGGAVGGWSNGDWIRFDNVDVSGKTNLNFNLATTINGTFRVVMGNYHGTEIGRLDYSPTGGWNNYNNQSVNLNLNGATGNQSIYIIASGGAANLGTLTMQ

SEQ ID NO: 541 - DNA, 1155 bp, Unknown
  Obtained from environmental sample
ttgaaaagaaaaagtgttaagttgtttttggcgattctattttgcatcttgctgatattaccagcaggaatggttagtgcacaaactgttactagcaattcaatcggtacacacggcggttatgactatgaattttggaaggacgctggcggatctggaactatgacgcttaatagtggtggtacatttagcgcacagtggagcggcatcaacaatattttattccgtaaaggtagaaagttcgaccaaacacaaacacatcagcagctcggtaacataacgattgactatgctgcaacttataatccgaatggaaattcatacttatgtgtatacggttggacagttgatccacttgtagagttttacatcgtggatagttggggcaactggcgcccaccaggagcaacagcaaaaggtacagttaccgttgatggtggcacgtacgatatttatgagacaactcgagtgaaccaaccttcgattattggagataccactttccaacaatattggagtgtaagaagaacgaaacgtacaagtggagtaatctctgtaagcgaacactttagagcgtgggaacgtttaggaatgccaatgggtagaatgtacgaagtggcacttacagtagaaggctggcaaagtagcggaagcgctaatgtaacgagaaatatccttacggttggcggcggctcgcaacctgcacctacccctccacctgcagagtttaatcctaacactcagtaccgaattatctcaaggctaagcaaccggtctcttgatgttgcgggtaattcaacgacaaatggggcaaacattcaacaatgggcatatggaggaggaaataaccaacgatggtttattcgaccagaggctaacggcacatatcgaatccaatctgtaagcagcgggaaggtacttgatgttgcagggagctcacaagctagtggtgcaaacgttcaacaatgggattggaataacaccggaaaccaatggtggacgatcgcactacaaggtgatggaagttatcgtatcacaaacttccatagcggaaaagctcttcatacaactggttccgataatggtgcaaacgttgagcaaagagattggaatagcagcaataaccagcggtggacaattgaacctgcaaactaa

SEQ ID NO: 542 - protein, 384 aa, Unknown
  Obtained from environmental sample
  SIGNAL (1)...(27)
  DOMAIN (36)...(223): Glycosyl hydrolases family 11
  DOMAIN (245)...(378): Ricin-type beta-trefoil lectin domain
  SITE (93)...(96): N-glycosylation site. Prosite id = PS00001
  SITE (211)...(222): Glycosyl hydrolases family 11 active site signature 2. Prosite id = PS00777
  SITE (223)...(226): N-glycosylation site. Prosite id = PS00001
  SITE (260)...(263): N-glycosylation site. Prosite id = PS00001
  SITE (269)...(272): N-glycosylation site. Prosite id = PS00001
  SITE (297)...(300): N-glycosylation site. Prosite id = PS00001
  SITE (331)...(334): N-glycosylation site. Prosite id = PS00001
  SITE (376)...(379): N-glycosylation site. Prosite id = PS00001
MKRKSVKLFLAILFCILLILPAGMVSAQTVTSNSIGTHGGYDYEFWKDAGGSGTMTLNSGGTFSAQWSGINNILFRKGRKFDQTQTHQQLGNITIDYAATYNPNGNSYLCVYGWTVDPLVEFYIVDSWGNWRPPGATAKGTVTVDGGTYDIYETTRVNQPSIIGDTTFQQYWSVRRTKRTSGVISVSEHFRAWERLGMPMGRMYEVALTVEGWQSSGSANVTRNILTVGGGSQPAPTPPPAEFNPNTQYRIISRLSNRSLDVAGNSTTNGANIQQWAYGGGNNQRWFIRPEANGTYRIQSVSSGKVLDVAGSSQASGANVQQWDWNNTGNQWWTIALQGDGSYRITNFHSGKALHTTGSDNGANVEQRDWNSSNNQRWTIEPAN

SEQ ID NO: 543 - DNA, 1014 bp, Unknown
  Obtained from environmental sample
atgggaaacatttcgagtttcacaaaattgcatgaagcatttaaagatcattttttaattggagctgcggtgaatccgtatacattaactaagcaaagtgagttacttaagcatcattttaatagtttaacagctgaaaatgaaatgaaatttattagtttacatcctactgaagatcaatacacatttgaacatgccgaccgcttatttgactttgcagaacaaaatggaatggaagttagaggtcatacacttgtgtggcataaccaaacatcaccatggatgtttgaaaatgctgacggaactacagtcgataaagaaacgctattggctcgtatgaaatcccatattgaaacggtaatgagccgctataaaggaagaatttatgcgtgggatgtagtgaatgaagcagtttctgataaaggagatgagtttcttcgtccttcaaaatggcttgatatcgctggtgaggactttattagtaaagcatttgaatatgctcatgctgttgacccagacgctctactattttataacgactataatgagtcagttccagaaaaaagggaaaaaatttataagcttgttaaatcattgaaggaaaaaggagtgccaatccacggtgttggtttacaggcacattggaacctagagtctccgtctctggatttaattcgggaggcaattgaaagatatgctagtcttggtatgaagctacatattacagagatggatgtttcagtatttaaccatgatgaccgtagaacggatttaaaagaaccaactgcagagatgcttgagcttcaggcaaaacgttatggagagatgtttggtctatttaaggaatacagtgagcatatcacttcagttaccctgtggggagcagcagatgactatacatggttaaacaattttccagtaagaggacgaaaaaattggccatttccttttgatgcagaacataatccgaaaaaatcttattttgaattaataaacgttgcaaactcaaaataa

SEQ ID NO: 544 - protein, 337 aa, Unknown
  Obtained from environmental sample
  DOMAIN (9)...(334): Glycosyl hydrolase family 10
  SITE (3)...(6): N-glycosylation site. Prosite id = PS00001
  SITE (90)...(93): N-glycosylation site. Prosite id = PS00001
  SITE (184)...(187): N-glycosylation site. Prosite id = PS00001
MGNISSFTKLHEAFKDHFLIGAAVNPYTLTKQSELLKHHFNSLTAENEMKFISLHPTEDQYTFEHADRLFDFAEQNGMEVRGHTLVWHNQTSPWMFENADGTTVDKETLLARMKSHIETVMSRYKGRIYAWDVVNEAVSDKGDEFLRPSKWLDIAGEDFISKAFEYAHAVDPDALLFYNDYNESVPEKREKIYKLVKSLKEKGVPIHGVGLQAHWNLESPSLDLIREAIERYASLGMKLHITEMDVSVFNHDDRRTDLKEPTAEMLELQAKRYGEMFGLFKEYSEHITSVTLWGAADDYTWLNNFPVRGRKNWPFPFDAEHNPKKSYFELINVANSK

SEQ ID NO: 545 - DNA, 1143 bp, Unknown
  Obtained from environmental sample
atgaataaaacatttagattaccaatcattttaatgggcatcctgctcacgttttcgtcagcacgctgctcaactcctgaacctacggattctcttagtgaggccttcgatggaatattttacataggcactgcaatgaacgagcggcagataaggggaacagataccaggggtgtcgaagtgatccttaagcattttaactccatagttgctgaaaaccatatgaaaagcggattgttacaaccagaagaaggtgtatttgattttgaacttgccgacaaatttgttgagtttggtgaaaagcataacaagcagattataggccacacccttatttggcactcacaggcacccaggtggttctttgtagatgacgatggaaacgatgtatcacgcgaggtattgattgaaaggatgcgcacccatatccatgccgttgcaggccgctacaaaggccggatacatggatgggatgtggtaaacgaagccattgttgatgatggttcatggcgcaacagtaaattctatcagatactgggagaagagtttgtcgaactggcattccgttttgcccatgaagctgatccccacgctgagttgtattacaacgactatagcatggcgcttccaggccgccgccagggagttattgatatggtaaagaacctgcaggccaaaggtgtaaagattgatggtattggtatgcagggtcatgtaaacgtcgatcctaattctccttctattgaagattttgagaaaagcattgttgcatttgctgaccttggggttacagtgatgatcaccgaaatggatgtaactgtgattccatggcccggacaaagggtaactgcagaagtatctctcaacattgagtacaaccgtgatctcaatccttatcccgatggtatttcagaggaaactgatcagaaacttcatgaccgttatcttgatttcttcaaactattcctcaagcaccaggacaagatatcacgtgttaccgtttggggtgtaagcgatggagactcatggcgaaataactggcccgttcgcggacgtaccgattatcctcttctgtttgatcgtgaccaccaacccaaaccggtggtgcaatcacttataaatgaagcattacgtaacagataa

SEQ ID NO: 546 - protein, 380 aa, Unknown
  Obtained from environmental sample
  DOMAIN (31)...(376): Glycosyl hydrolase family 10
  SITE (2)...(5): N-glycosylation site. Prosite id = PS00001
MNKTFRLPIILMGILLTFSSARCSTPEPTDSLSEAFDGIFYIGTAMNERQIRGTDTRGVEVILKHFNSIVAENHMKSGLLQPEEGVFDFELADKFVEFGEKHNKQIIGHTLIWHSQAPRWFFVDDDGNDVSREVLIERMRTHIHAVAGRYKGRIHGWDVVNEAIVDDGSWRNSKFYQILGEEFVELAFRFAHEADPHAELYYNDYSMALPGRRQGVIDMVKNLQAKGVKIDGIGMQGHVNVDPNSPSIEDFEKSIVAFADLGVTVMITEMDVTVIPWPGQRVTAEVSLNIEYNRDLNPYPDGISEETDQKLHDRYLDFFKLFLKHQDKISRVTVWGVSDGDSWRNNWPVRGRTDYPLLFDRDHQPKPVVQSLINEALRNR

SEQ ID NO: 547 - DNA, 1149 bp, Unknown
  Obtained from environmental sample
atgactcgcctctctcgccgcaactttctggtcggcagtgctgctgtcgccgccatggccaatatcaaggcgtgcgccatcaaccgcgctgccgagaataccggcttaaaagacgtctacaaggacgacttcctgatcggcactgccatcagcaacggcaccctggagcacggtaacccgcaacttgaaagcatcatcaagcaggagttcaactcgattgtagcggaaaactgcatgaaatccggcctgatccagccgcgtcagggcgagtgggactggaccctggcagaccgctttatcgactttggtgtcgagaacgacatgaccatcgtcgggcatgcactggtctggcactcgcaagcgccggcagacttttttatccacgaagatgggcgccggatttcccgcgaagagctgatccgacgcatggatacccatatcaccaccctgatggagcgctacaagggcaaagtccatatctgggatgtggtcaacgaatccattgacgaggaccagggctggcgccagagcctctggtatcaggtgatgggctctgcttatttccaggagcgcgccttcaatctcgcccatgagatcgaccccaatgcacacctgatttacaacgactacaatatgcacaaccccggcaagcgggagttcctggttgacgttatccgcgactacaagcgccgcggcgtcccgattcacggcgtaggcatgcagagtcatgttgggctggattggcctgatatggacgaatacgaggccagcattgaggcatacgccgcagagggcatgcgcctgcacatgactgagctggaagtggatgttttacccgtggcttgggagcacagtggtgcagaaatttcgacggagtttgagtactcggatgagattaacccctacactgacggcttgccgcaagctatcgaagatcagttgacacgccgctacgaagagctgttcaccttgtacgtcaaacatcgcgacaagatcgaccgtgtgacgacctggggcacttatgacggtgagtcctggaaaaatgacttcccggtgcgtggacgcactaactacccgctgctgttcgatcgcgatatggcacccaaggatgcttattttgcgctgaagagtttgcgcgctcgtttgtaa

SEQ ID NO: 548 - protein, 382 aa, Unknown
  Obtained from environmental sample
  SIGNAL (1)...(20)
  DOMAIN (35)...(379): Glycosyl hydrolase family 10
  SITE (52)...(55): N-glycosylation site. Prosite id = PS00001
  SITE (167)...(170): N-glycosylation site. Prosite id = PS00001
MTRLSRRNFLVGSAAVAAMANIKACAINRAAENTGLKDVYKDDFLIGTAISNGTLEHGNPQLESIIKQEFNSIVAENCMKSGLIQPRQGEWDWTLADRFIDFGVENDMTIVGHALVWHSQAPADFFIHEDGRRISREELIRRMDTHITTLMERYKGKVHIWDVVNESIDEDQGWRQSLWYQVMGSAYFQERAFNLAHEIDPNAHLIYNDYNMHNPGKREFLVDVIRDYKRRGVPIHGVGMQSHVGLDWPDMDEYEASIEAYAAEGMRLHMTELEVDVLPVAWEHSGAEISTEFEYSDEINPYTDGLPQAIEDQLTRRYEELFTLYVKHRDKIDRVTTWGTYDGESWKNDFPVRGRTNYPLLFDRDMAPKDAYFALKSLRARL

SEQ ID NO: 549 - DNA, 981 bp, Unknown
  Obtained from environmental sample
atgactactttaaaatcgtattataaagatcaattcaaaattggtgcagcaattaatatgcgttcgatcaaagaagatgcagatttattaaaagaacagtttaattcaatcacagctgagaatgagatgaaatttgaagggcttcagccagaaaaaggccaatttaattttgaaattagtgatcagtttttagcatttgctgaggaaaatgatatgggtttacgtggtcacacacttgtctggcataaccaaacaccagattggttcttccaagatgatgacggcaatgacgtgtcgagagacgtgttactcgaacgtatgaaagagcatatcgaaacggttgttggacgctataaagggcgtatttacgcatgggacgtcgtaaacgaagcgatttctgatgaagaaggtgtcttcctaagaccgtctaaatggctggatattattggtgaagatttcctagatcatgccttcaaatttgcgcatgcggttgatcccgaagctaaactcttctataacgactacaacgaatcaaatccggaaaaacgcgagaagatttacacgctaattagtggcatgatctcacgtggtgttcccattcatggtatgggcatgcaagcccactggaatcttcatgagccagctttaacggatattgaagatgcgattgtgagatacggtgaattaggggtagaaattcacgtgactgagatggatgtatctgtcttcaagtttgatgataagcggacagatttaatagagccaacggaagaaatggaaaaattgcaggttgaacgttatgaagcattctttgatctctttaagaaacatgcttcaaaaattacatctgttaccttctggggtgtatctgaccgttacacatggttaaatgatttccctgtccgtggcagaaaaaactggccatttgtatttgatggcaataaccagccgaaagcatcatttaaagcgatcactaaataa

SEQ ID NO: 550 - protein, 326 aa, Unknown
  Obtained from environmental sample
  DOMAIN (3)...(326): Glycosyl hydrolase family 10
  SITE (178)...(181): N-glycosylation site. Prosite id = PS00001
MTTLKSYYKDQFKIGAAINMRSIKEDADLLKEQFNSITAENEMKFEGLQPEKGQFNFEISDQFLAFAEENDMGLRGHTLVWHNQTPDWFFQDDDGNDVSRDVLLERMKEHIETVVGRYKGRIYAWDVVNEAISDEEGVFLRPSKWLDIIGEDFLDHAFKFAHAVDPEAKLFYNDYNESNPEKREKIYTLISGMISRGVPIHGMGMQAHWNLHEPALTDIEDAIVRYGELGVEIHVTEMDVSVFKFDDKRTDLIEPTEEMEKLQVERYEAFFDLFKKHASKITSVTFWGVSDRYTWLNDFPVRGRKNWPFVFDGNNQPKASFKAITK

SEQ ID NO: 551 - DNA, 1470 bp, Unknown
  Obtained from environmental sample
gtgcgtggcgacgcctctatcagtcgtgtaacgtcagagcgttttgagggtaacgctagtttaagtgtgaccggtcgcactgattattggcacggcgccactttttctgtgggtcatttaacaccgggcaatagctatgaagtagctgtttgggtgaagttggcggcgggcgagccgaatgctgtggtcaaggtcaccggcaagcgtgaaggcaacagctccacctatgttgaatacatggaggtcggctcagctctggctaccgccggtagctggaccgagattacgggcacctatgtcccggagagtgacagcccctttgagttctttattatagaaactcaggaaggcgaggctgataccagcttctatgtggacgcgttttccgtagccggtgaggtggcgcccaccccaacgccagtgatgccgccaccgggtggcggttcagggctggctgggctggtggacttccctgtagggactgctgttgcggttgccagtttcgcaaacaacgattttttaagtgacgcgcagcagcaggccattgtgcgtgaaaacttcaatgaaatcgtcgcagaaaaccagatgaagatggaatacttcggcagcgactattcgaaccccagggcggatcaactggttagttgggctaatcagaatggtattcgggttcatggtcacgctctggtttggcatgcgcagccggccgcgtgggtaagcacggctacgggcagtgatttccgccagcgctatgttaaccatgttcgaggggtggccgctcgctacgctgattcggtcgtgagttgggacgtggtcaatgaggccttgactgacagtaatgtttcaccgggtggaaactattaccggcagtcggcattttatcagcaatttggtggtccggagttcattgatatcgcattccgggaagcgcgtcaagccgccccgaatgcgctgttgtactacaacgattacaacattgagaacgggggggataaaaccgacgggctgattcagttgctcgagcggctggtggccaatggtgtacccatcgacggtgtaggcttccaaatgcacgtcttacgagattggccagatatctcaaccattcgccgctcttgggagcgggcgttggccgttcatccagacctgttgctgaaaattaccgaattggatgtgcgtatcaacaatccctacggtgatagtattattcacaccaatcgaaacgactgtaataatggttgccgagggttcgacctacaggccgagcgctatcgagaaattatagaagcttatttcgaggtggtgcctccgcatcgtcgtggtggtataagcgtctggggtattgcggaccactacagctggtattatacccacgaaggcttggtagattggcctctgctatgggatcgcaacttgcaaccgaaacctgcctatcatgctgtctatgaggcacttcgtcaggggcagtag

SEQ ID NO: 552 - protein, 489 aa, Unknown
  Obtained from environmental sample
  DOMAIN (2)...(133): Carbohydrate binding domain
  DOMAIN (150)...(485): Glycosyl hydrolase family 10
  SITE (18)...(21): N-glycosylation site. Prosite id = PS00001
  SITE (73)...(76): N-glycosylation site. Prosite id = PS00001
MRGDASISRVTSERFEGNASLSVTGRTDYWHGATFSVGHLTPGNSYEVAVWVKLAAGEPNAVVKVTGKREGNSSTYVEYMEVGSALATAGSWTEITGTYVPESDSPFEFFIIETQEGEADTSFYVDAFSVAGEVAPTPTPVMPPPGGGSGLAGLVDFPVGTAVAVASFANNDFLSDAQQQAIVRENFNEIVAENQMKMEYFGSDYSNPRADQLVSWANQNGIRVHGHALVWHAQPAAWVSTATGSDFRQRYVNHVRGVAARYADSVVSWDVVNEALTDSNVSPGGNYYRQSAFYQQFGGPEFIDIAFREARQAAPNALLYYNDYNIENGGDKTDGLIQLLERLVANGVPIDGVGFQMHVLRDWPDISTIRRSWERALAVHPDLLLKITELDVRINNPYGDSIIHTNRNDCNNGCRGFDLQAERYREIIEAYFEVVPPHRRGGISVWGIADHYSWYYTHEGLVDWPLLWDRNLQPKPAYHAVYEALRQGQ

SEQ ID NO: 553 - DNA, 1116 bp, Unknown
  Obtained from environmental sample
atgacgggaatcagcacaggccggggaaagaacccgggccggatctacacgacgttgagcacggcactggtgttcgtggtgatgggggcgttggagtcctgggcgcagtgcagcacctggaccagaagcaccatccgcaattgcaacggcatcgattacgagctgtggaaccagggcaaccgcggcacggtgaacatgcaaatcacgggcgggagcgccgatacgaacggcggtacgttctcggcgacctggaccgggacggagaacatcctgttccgcgcgggcaagaagtggggtttcaataccaccacgacgcctgaggaccttggcacgaccacgcttgatttcgaagcgacctggacatcgagcgacaacgtgaggatgctgggcgtgtatggctggtcgtattttcagcccgaggacgtgccgaccgagagggaaaacggtcaggccactgagttttccaatcagatcgagtattacatcatccaggatcgcggaagcttcaatccgggtgccagcggtgtgaacgccaagaagtatggcgaagccaccatcgacggaatcgcctacgatttttgggttgccgaccgcatcaatcagcccatgctgaccgggagaggaaacttcaagcagtacttcagcgttccacagaatacgggaacccaccggcaaagcggtaccgtcaccatctccgagcattttgaggagtgggagaaggccggcatgaagatgatgaatacccggttgtacgagatcgcgatgaaggtggagtcgtattccggtgctgcgactggttccgggtcagcgcatgtgacccgcaacctcctgacgttcgagaatgtggccgcctcgatcacgcacgccggagggactgctgccatgtccgccggaaacgcgccggttgtgttggtgcagggcagaaccctgaacgtgaatcccgtcgatggttcccggttgcagattcaggtgcgggatgcgaagggcacgaaccacggccgcttcaacgccaccggcgccgcggcgttttcgttgtccgaaatccccgcgggcctgtacttcgttgatgtcacggggaccgggacacgacacgtcacgccgatcatcttgcgctga

SEQ ID NO: 554 - protein, 371 aa, Unknown
  Obtained from environmental sample
  DOMAIN (46)...(274): Glycosyl hydrolases family 11
  SITE (102)...(105): N-glycosylation site. Prosite id = PS00001
  SITE (341)...(344): N-glycosylation site. Prosite id = PS00001
MTGISTGRGKNPGRIYTTLSTALVFVVMGALESWAQCSTWTRSTIRNCNGIDYELWNQGNRGTVNMQITGGSADTNGGTFSATWTGTENILFRAGKKWGFNTTTTPEDLGTTTLDFEATWTSSDNVRMLGVYGWSYFQPEDVPTERENGQATEFSNQIEYYIIQDRGSFNPGASGVNAKKYGEATIDGIAYDFWVADRINQPMLTGRGNFKQYFSVPQNTGTHRQSGTVTISEHFEEWEKAGMKMMNTRLYEIAMKVESYSGAATGSGSAHVTRNLLTFENVAASITHAGGTAAMSAGNAPVVLVQGRTLNVNPVDGSRLQIQVRDAKGTNHGRFNATGAAAFSLSEIPAGLYFVDVTGTGTRHVTPIILR

SEQ ID NO: 555 - DNA, 1071 bp, Unknown
  Obtained from environmental sample
atgaagttcagtcatataagatcgctgtccctcgcgctggttctgtgttttaccgggtttggcgtgtcgacagttcatgctcaaacccattgcgggagccagacaggcaaccatggcggtttctactttacccactggaccgatggtggtggtagtgcctgcatgaccctgggctccggtggcaactacagctattcctggtccaacaccggcaactttgttggcggcaagggctgggcaaccggcaccaataaccgggttatcggctacaacgccggggtgtttgcgccggcaggtaattcgtacctggcgctctacggatggaccaccaaccctctggtggaatactacgtggtggatagctggggcagctggcggccgccgggtgcgcagtcggcaggtacagtgaacagcgatggtggcacctacgacctgtacagaacccagagagtcaaccagccctccattcagggaactgccaccttctatcagtactggagtgtgcgcacgtctccgcgtccccagggaaccaacaacaatatcaccttccagaatcacgtgaacgcctgggcgtccaggggctggaacctcggtgcccataactatcaggtgatggccaccgaaggctaccagagcagcggttcttccaacgtgaccgtgtgggaatccggaaccagcggtggtggtggcggtggtgccaccggcggtggcggcggtggtggtgctaccggcggtggtggtcagcacaccatcgtggttcgcgcccgcggcgttcacggcagcgagcagatccgcctgcggatcaacaacaacactgtggcgacctggaacctgtcgaccaacatgagcaactacacctggagcggcaacaataccgggggtattgtcgtggagtttttcaacgacaacagcgttcgcgatgtgcaggttgagcacattcaggtcaacggtcagacccggcgcgcccaggatcagacctacaacacgggtgtctggcaaaacaactcctgtgggggttcccacagccagtggctgcactgcaacggtgcgataggatttggcaatatctag

SEQ ID NO: 556 - protein, 356 aa, Unknown
  Obtained from environmental sample
  SIGNAL (1)...(27)
  DOMAIN (36)...(220): Glycosyl hydrolases family 11
  SITE (62)...(65): N-glycosylation site. Prosite id = PS00001
  SITE (113)...(123): Glycosyl hydrolases family 11 active site signature 1. Prosite id = PS00776
  SITE (182)...(185): N-glycosylation site. Prosite id = PS00001
  SITE (208)...(219): Glycosyl hydrolases family 11 active site signature 2. Prosite id = PS00777
  SITE (220)...(223): N-glycosylation site. Prosite id = PS00001
  SITE (274)...(277): N-glycosylation site. Prosite id = PS00001
  SITE (281)...(284): N-glycosylation site. Prosite id = PS00001
  SITE (285)...(288): N-glycosylation site. Prosite id = PS00001
  SITE (294)...(297): N-glycosylation site. Prosite id = PS00001
  SITE (339)...(342): N-glycosylation site. Prosite id = PS00001
MKFSHIRSLSLALVLCFTGFGVSTVHAQTHCGSQTGNHGGFYFTHWTDGGGSACMTLGSGGNYSYSWSNTGNFVGGKGWATGTNNRVIGYNAGVFAPAGNSYLALYGWTTNPLVEYYVVDSWGSWRPPGAQSAGTVNSDGGTYDLYRTQRVNQPSIQGTATFYQYWSVRTSPRPQGTNNNITFQNHVNAWASRGWNLGAHNYQVMATEGYQSSGSSNVTVWESGTSGGGGGGATGGGGGGGATGGGGQHTIVVRARGVHGSEQIRLRINNNTVATWNLSTNMSNYTWSGNNTGGIVVEFFNDNSVRDVQVEHIQVNGQTRRAQDQTYNTGVWQNNSCGGSHSQWLHCNGAIGFGNI

SEQ ID NO: 557 - DNA, 1371 bp, Unknown
  Obtained from environmental sample
atgtcttcattaatagcaggcaccattgcctgttgcatgatgatgatgcccctaatactggctcccagccaggtgcacgcgcaacaacattgctcaaatcaaaccggctaccacggtggctactatttcacacactggactgatggtggcggaacagcatgtatgacacttggtgccgatggtaactacagttacagctggtctaataccggaaattttgtaggtggtaagggctggagtaccggtacttcaaaccgaatcatcggatacaatgccggtgtctataacccaagtggtaatagctatctggctctgtatggttggtcaaccaatccacttatcgagtactatgttgtagatagctggggaagctggagaccaccaggaggtacttctgtaggtactgtacaatcagatggcggaacctacgacctgtaccgaacacagcgtgttaatcagccttccattgaaggaacagctacgttttatcagtattggagtgtacgtacaactccgagaccacaaggccaaaacaataccattacctttcaaaatcacgtaaatgcctgggctaatcagggctggcatctgggtgctcataactatcaggtgatggctactgaaggataccagagtagtggtagctcaaacgtttctgtgtgggaagctggaagcggttccggaggtggttctggcggcggtggcggatcaaactccgttaccatcagagctattggaacttcaggtaacgaacaactccggttgaacatcaacaacaatgaaatcattacctggaacatcaccagcagctggcagaattactccgttaacaccaatgccagcggacatgtgaatatagagctgatcaacgatcagggtcctggctacgaagcccgtgtggaatacatggaactgaacggtcagcggcgttatgcggcagatcaaagctacaacaccagcgcctgggatggtgagtgcggtggtggctcgttcaccatgtggatgcattgtaacgggatgataggttttggcgatatgccacagagcagagccgaacgcaatgaaggaataagcaatactctggatttgccaactgacttcaagctctcgggtgcctatccgaatccgtttaatccaacaactaacatccgctttgatttaccggtttcctctcaggttacgctaaccgtatatgacgcgcttgggcgccaggtaagccagcttattaatggaaaccgtggagcaggcagccatctggtaacttttgatgccggcaacaatcccagtggtatatacctctacaggattgatgcttatggcgaagacggcagatcattctccgataccggtattatgacactggttaagtaa

SEQ ID NO: 558 - protein, 456 aa, Unknown
  Obtained from environmental sample
  SIGNAL (1)...(27)
  DOMAIN (36)...(220): Glycosyl hydrolases family 11
  SITE (33)...(36): N-glycosylation site. Prosite id = PS00001
  SITE (62)...(65): N-glycosylation site. Prosite id = PS00001
  SITE (113)...(123): Glycosyl hydrolases family 11 active site signature 1. Prosite id = PS00776
  SITE (180)...(183): N-glycosylation site. Prosite id = PS00001
  SITE (208)...(219): Glycosyl hydrolases family 11 active site signature 2. Prosite id = PS00777
  SITE (220)...(223): N-glycosylation site. Prosite id = PS00001
  SITE (270)...(273): N-glycosylation site. Prosite id = PS00001
  SITE (277)...(280): N-glycosylation site. Prosite id = PS00001
  SITE (283)...(286): N-glycosylation site. Prosite id = PS00001
  SITE (322)...(325): N-glycosylation site. Prosite id = PS00001
MSSLIAGTIACCMMMMPLILAPSQVHAQQHCSNQTGYHGGYYFTHWTDGGGTACMTLGADGNYSYSWSNTGNFVGGKGWSTGTSNRIIGYNAGVYNPSGNSYLALYGWSTNPLIEYYVVDSWGSWRPPGGTSVGTVQSDGGTYDLYRTQRVNQPSIEGTATFYQYWSVRTTPRPQGQNNTITFQNHVNAWANQGWHLGAHNYQVMATEGYQSSGSSNVSVWEAGSGSGGGSGGGGGSNSVTIRAIGTSGNEQLRLNINNNEIITWNITSSWQNYSVNTNASGHVNIELINDQGPGYEARVEYMELNGQRRYAADQSYNTSAWDGECGGGSFTMWMHCNGMIGFGDMPQSRAERNEGISNTLDLPTDFKLSGAYPNPFNPTTNIRFDLPVSSQVTLTVYDALGRQVSQLINGNRGAGSHLVTFDAGNNPSGIYLYRIDAYGEDGRSFSDTGIMTLVK

SEQ ID NO: 559 - DNA, 996 bp, Unknown
  Obtained from environmental sample
atgacaaatcaaatggaatctttgtatcaaaagtatcaaccttactttccaattggaacatgcgtcagtccacgtacactagaaacacataaggagctacttatcaagcattataatagcttgacatcagaaaacaatatgaagtttggaccgattcatcctggtattgatgaatatgactttgttgaagcagataaaatggttgagtttgctagaaaccacaataagctagtgcgagggcacactttagtatggcatggtcaaaaccctaagtggttgttccataatcaagatggtagtcttgtcgatagagctaccctcttaaaacgtatgaaagaacacatcaataccgtggttagccggtatcgtgatgatgtttattgctgggatgtagttaatgaagctgtagatgacaagggctcgaacatcttaaggcaatctttatgggtagacattgttggtgaagacttcatccagaaggcattcgaatatgcccacgaagttgatccaaaagcactgctgttttataacgattataacgaaagccaaccagttaaacgagataaaatctatcaattggttaagggcttaaaggacaaggatgtaccaattcatggtgttggtttgcaggctcactggaacattcacggtccagccatggatgacattcgtcaagcaattgaaaaatatgctacgctaggtttacagctacatattactgagcttgacgtatctgtattcgaacacgatgataagcgtaccgatttaactgagccagccgatggaatgctagataaactagctgagcgatatgataatttcttcagcttgtttagggagtactctgaagtgattgcaaatgtaactttttggggtccagctgatgatgctacctggttggatggtttcccagcgccgggacggaaaaactggccgctgctatttgacgtacatcataaaggtaaaaaagcattagaaaaagtgatgaacttctaa

SEQ ID NO: 560 - protein, 331 aa, Unknown
  Obtained from environmental sample
  DOMAIN (7)...(331): Glycosyl hydrolase family 10
  SITE (182)...(185): N-glycosylation site. Prosite id = PS00001
  SITE (237)...(247): Glycosyl hydrolases family 10 active site. Prosite id = PS00591
  SITE (291)...(294): N-glycosylation site. Prosite id = PS00001
MTNQMESLYQKYQPYFPIGTCVSPRTLETHKELLIKHYNSLTSENNMKFGPIHPGIDEYDFVEADKMVEFARNHNKLVRGHTLVWHGQNPKWLFHNQDGSLVDRATLLKRMKEHINTVVSRYRDDVYCWDVVNEAVDDKGSNILRQSLWVDIVGEDFIQKAFEYAHEVDPKALLFYNDYNESQPVKRDKIYQLVKGLKDKDVPIHGVGLQAHWNIHGPAMDDIRQAIEKYATLGLQLHITELDVSVFEHDDKRTDLTEPADGMLDKLAERYDNFFSLFREYSEVIANVTFWGPADDATWLDGFPAPGRKNWPLLFDVHHKGKKALEKVMNF

SEQ ID NO: 561 - DNA, 1809 bp, Unknown
  Obtained from environmental sample
atgtctttgagtaaacataaatcactgcttcttgccgtgagccgctacacttgcgcagctctgttggcgggtagcttagtcgcctgcggtggcaacaccaccacagagcccccaacaccaacgccaaccccaacgccggtgccaacccccgccccgacgccagttccaactccggcacccacaccagcacctacgccagcacccacaccggcgcctacgcccgctcccaccccaactccggatcccggagctaactatcagccaccggccaacaacatagccgtcaatggcgatgtagagaatggcacgaccaattgggccgctcgcggcgacgcgtcaatagcgcgagtcacttctgagcgttttgagggcaacgccgccttgagcgtaaccgggcgcacagatttctggcaaggcgccaccttttcggtaggccacctgacaccaggtaatagttacgaagtggccgcatgggtcaaattggctgccggcgagcccaacgccgtgattaaaatcactggtaagcgcgaaggcgaaagcaccacctacgaggaatacacagaagtcggcacagccttggtcacggctaacacctggaccgaaattacgggtacttatattccagagagcaccagcccgtttgaatacttcattgtggagacgcaagaaggtgaagctaacgtcagcttctatgttgacgccttctcggtggctggtgaagttagcgccaccccaacgcctacccccactccaactccgccccccagtggttccggactggcggcattggtggacttccctgtaggggttgccgtaccagtgaacaacttcctcaatagcactcagcgccaaagcattgtggccgacaacttcaatcagctggtagcagaaaaccagatgaagatgaactactacgatgaaaacaacttctctaacccactggctgaccaaatgatcgactgggcgcggactagagggatgacggtacacggtcatgccttggtatggcacccgacttaccagttgccaagctgggccgaaaacccaggttcaaacttccgccagcggtacgaagctcacgttcgtggagttgcacgcaagcaccgagggcaaattgcaagctgggacgtggtcaacgaagctctatctgacgcaaacggcaataataatgttagcaatcccgctgactactatcgtcgttcggtattttataatcagtacaacggtattgattatatagccaatgctttcatttgggcgcgcgaggaggatccaaacgcagagctgtattacaacgactacaatactgacgaaaacctggctaaaacccgtggtcaagtgcatttaatcagcgagctattgcgtcgtggcgtgccaattgacggtgtcggtttccagatgcacgtgttgctggactatccgagcttggcaaacattcgtgcatcctggcgtacgattttagatttggacccgaatctaaaactcaaaatcaccgagctggacgtgcgtatcaataacccctggggcactattctccaccccaaccgaaacgactgcaatcagggctgtcaaggctggaatacccaagctaatcgctatcgcgagatcatcgaggcctaccttgaggacgtgccacctcatcgccgcggcggcatcagcgtctggggcatttcggataatgatagctggtactacacccatgatgacggcgacggttccaataatattgtagactggcccctgctgtgggactccaactttcaacctaaaccggcttatcaggccgtatacgacgctctaagccgataa

SEQ ID NO: 562 - protein, 602 aa, Unknown
  Obtained from environmental sample
  DOMAIN (91)...(240): Carbohydrate binding domain
  DOMAIN (257)...(600): Glycosyl hydrolase family 10
  SITE (32)...(35): N-glycosylation site. Prosite id = PS00001
  SITE (102)...(105): N-glycosylation site. Prosite id = PS00001
  SITE (230)...(233): N-glycosylation site. Prosite id = PS00001
  SITE (283)...(286): N-glycosylation site. Prosite id = PS00001
  SITE (313)...(316): N-glycosylation site. Prosite id = PS00001
  SITE (568)...(571): N-glycosylation site. Prosite id = PS00001
MSLSKHKSLLLAVSRYTCAALLAGSLVACGGNTTTEPPTPTPTPTPVPTPAPTPVPTPAPTPAPTPAPTPAPTPAPTPTPDPGANYQPPANNIAVNGDVENGTTNWAARGDASIARVTSERFEGNAALSVTGRTDFWQGATFSVGHLTPGNSYEVAAWVKLAAGEPNAVIKITGKREGESTTYEEYTEVGTALVTANTWTEITGTYIPESTSPFEYFIVETQEGEANVSFYVDAFSVAGEVSATPTPTPTPTPPPSGSGLAALVDFPVGVAVPVNNFLNSTQRQSIVADNFNQLVAENQMKMNYYDENNFSNPLADQMIDWARTRGMTVHGHALVWHPTYQLPSWAENPGSNFRQRYEAHVRGVARKHRGQIASWDVVNEALSDANGNNNVSNPADYYRRSVFYNQYNGIDYIANAFIWAREEDPNAELYYNDYNTDENLAKTRGQVHLISELLRRGVPIDGVGFQMHVLLDYPSLANIRASWRTILDLDPNLKLKITELDVRINNPWGTILHPNRNDCNQGCQGWNTQANRYREIIEAYLEDVPPHRRGGISVWGISDNDSWYYTHDDGDGSNNIVDWPLLWDSNFQPKPAYQAVYDALSR

SEQ ID NO: 563 - DNA, 2067 bp, Unknown
  Obtained from environmental sample
atgcagtcactctttctttttcttgttgttttcttttttacgcagactcaggtgtttggtcaggcggcgaatcaccctttcccacagaatctgcagtatccccatggttacatacccactaatttgagtcacaccgatgtgcagacctggtgggacacctggaaaaccacatttctgcgtccttgtggggatgggcttatgcccactgcagatgatcgtgatcatgttaaggtggaaggacagggctgggcgatgattgccgctgcttacatgggtgataaggaaacctttgatggcctcttgcgtttttataatatgaaaaccacagacagagccggtggtatgatgggctggcatgtgacctgcgatggctttgttgatgagggtagtgcaactgatggtgatctggatgtggcttttggcctgattgtggctcactggcagtggggtggagaatacctagatgccgctcgccaggtaatcaccaacctcaggagtctgatcgtggattgtgatggtgtttcggtgctggctgctggttttgccggcggaccttggggtggttgcagtgaaacggatatttcctattacacgccagctcattttcgcatctttgcggaagtaagcaatgacccgatctggactaagctagccgaagatacgtacattctgctggaacgggcagcgcatcctactaccggattggtgccagattggcagcatgccgacggtaccgcaggtgctggcagtcgtcgcggcgattactctcatgatgcctgtcgtactccttggcgtattgcgctggattatctgtggaatggtgatgagcgggcaaaaagctggctgaccaaggtgactgattgggcgcatggtgtgggccctgccaacattgtggacggttatgacctggatggtactcctaccgggcagcacaatgatatgccttttgtgggtggctttgcagtgggcgccatggcaaatagtcaaactgtagtcaatgattttgcagcgcgggtggcgcagttcagtcaaggctactggtatggggcgcatttggggaatatgtatctgctggctctgactggcaatatgtggagcgaagatcttttggtaagcactgagggtacttatgtcttgagtgtgacagtggatggtcggggaaccgtcaatcgcagtccttcggccattcgctatgccgccggtacttctgtaactttgactgcggaaccggctgttggttggtcctttgatggctggagtggtgccgggctctctggagcagagccttctgttaccgttaccgttgatgaggcaatccatgtgacggcacattttgtgttggatatcggtcccaataccaatctgttgcaaaacggtgatttcagcggagatctggctccctgggcgttgaatacatggaccggcgcagcatccggtgctatcagtgatggggaatacacgctgaatatcacagagttgcctgaaaatgtgtgggatgtccaattggttcagcagcaagtgcctttacaggaaggtcagacatacgtactgagttttgaagcttttgcggatgcaccccgggatatcagtatcatagcccagttacctgccgagccttataccacataccattcggaagatgtaagcattactgctaccaaacaaatgtatgaggtggagtttactatggaagacgaaagcaatctggattcccgtattggtttcaatcttgggcaggctaccggtaatgtcaccatcagtaatgttcgactggcacctaccggaacagtcagtacagttcttcccttgcagcgcgcccggactggtctgagtgtgcagcctcttgccaatgctgcagtcaatctgcaatttcaggccattgcaggtggaaatgccatactgcgcatttatgatgtgagaggcaatgtggtggaaggcattctgctgcagccttcggcggatggtgtgtatttgcacaccaccgccagtatgcccaatggcttttacatagctcgtgtatatcaaaatggtgttacacagcaagcgtcttttgcggtaagtcgctga

SEQ ID NO: 564 - protein, 688 aa, Unknown
  Obtained from environmental sample
  SIGNAL (1)...(20)
  DOMAIN (25)...(362): Glycosyl hydrolases family 8
  DOMAIN (453)...(594): Carbohydrate binding domain
  SITE (41)...(44): N-glycosylation site. Prosite id = PS00001
  SITE (496)...(499): N-glycosylation site. Prosite id = PS00001
  SITE (591)...(594): N-glycosylation site. Prosite id = PS00001
MQSLFLFLVVFFFTQTQVFGQAANHPFPQNLQYPHGYIPTNLSHTDVQTWWDTWKTTFLRPCGDGLMPTADDRDHVKVEGQGWAMIAAAYMGDKETFDGLLRFYNMKTTDRAGGMMGWHVTCDGFVDEGSATDGDLDVAFGLIVAHWQWGGEYLDAARQVITNLRSLIVDCDGVSVLAAGFAGGPWGGCSETDISYYTPAHFRIFAEVSNDPIWTKLAEDTYILLERAAHPTTGLVPDWQHADGTAGAGSRRGDYSHDACRTPWRIALDYLWNGDERAKSWLTKVTDWAHGVGPANIVDGYDLDGTPTGQHNDMPFVGGFAVGAMANSQTVVNDFAARVAQFSQGYWYGAHLGNMYLLALTGNMWSEDLLVSTEGTYVLSVTVDGRGTVNRSPSAIRYAAGTSVTLTAEPAVGWSFDGWSGAGLSGAEPSVTVTVDEAIHVTAHFVLDIGPNTNLLQNGDFSGDLAPWALNTWTGAASGAISDGEYTLNITELPENVWDVQLVQQQVPLQEGQTYVLSFEAFADAPRDISIIAQLPAEPYTTYHSEDVSITATKQMYEVEFTMEDESNLDSRIGFNLGQATGNVTISNVRLAPTGTVSTVLPLQRARTGLSVQPLANAAVNLQFQAIAGGNAILRIYDVRGNVVEGILLQPSADGVYLHTTASMPNGFYIARVYQNGVTQQASFAVSR

SEQ ID NO: 565 - DNA, 1515 bp, Unknown
  Obtained from environmental sample
atgaacagttatagagctttaatgttgggcttattaggcggcctgatattgacgggatgtggagctggtcaggatagcccaacccccggcagctccagtgccataagttcatccagtgagagcttttccagcgtgaccagtgagagttcttccagcgccatatcgagtactgcctcatctgcgccgccaaactatgaggtgccagagaataatttcgctgtgaacggcgatgtggagcaggggttggacaactggggggcgataggcggaacggtaagccgatccacctctgaaagccgaagcggtgccgccagcgcattgattacaggtcgtacagcctcttggaacgggcttactttttatgtcggtcatctgactcaaggcaacgaatacgaagtggccgtctgggtcaagctggcttcgggatccccagataccacattgatcctcaccgccaagcgccacgatgatgatgatccgtctaccttcttagagtacaccaacattgctatggctaccgcctcagcgagtaattggactttgttgcacggatattacacccaggcgggcacgccttttcaacactttattatcgagtcctccgacgataccgtcagctactacgccgatgatttttccgtagcgggtgaagtagagccaatcgccggccaagggcatgagttctttgtcggtaatatcactacttcgggtaatgtaaggtcggattttatccagtattgggatcagattacgccagagaatgagggtaaatgggagtccgttgagagggtgcggggtgtgtatgactggagcggtaccgatcgcgtctacgcttacgcgcgtgaacataacattcccgtgaaggctcatgcttttgtctggggcagccaatacccgagttggatcacctctctcagcccccaagaacaagcagaagccattgaacgctggatacgtgactactgtgcgcgataccccgataccgccatgatcgatgtggttaacgaagccacaccagatcatgcaccggctgagtttgcccgcagcgcctttggtgaaaactggattattcgttcgttcgagttggcccgccagtattgcccaaatgccattctaatactcaatgattacaacgtgcttagttggaacacggaaggatttatcaatatggcacgtccggttattaacgccggagtggtagatgcacttggcctgcaggcgcacggtttggccgactggtctttggcggatatagagcgaaaactcaatgaagtggcggcgttagggttgcccatctatatctctgaatatgatattgaaaagaccaacgatcaagagcagctcgatgtgatgcgcacgcagttcccgcttttttataaccatccctcagtagttggcattaccctgtggggctacgttgaggggcgaacctggcggcctggaaccgggctaattcatgaggacggacgtcaccgccccgcgatgacttggttaatggactatctgggtcgttag

SEQ ID NO: 566 - protein, 504 aa, Unknown
  Obtained from environmental sample
  SIGNAL (1)...(60)
  DOMAIN (70)...(217): Carbohydrate binding domain
  DOMAIN (203)...(502): Glycosyl hydrolase family 10
  SITE (180)...(183): N-glycosylation site. Prosite id = PS00001
  SITE (235)...(238): N-glycosylation site. Prosite id = PS00001
  SITE (375)...(389): Trp-Asp (WD) repeats signature. Prosite id = PS00678
  SITE (435)...(445): Glycosyl hydrolases family 10 active site. Prosite id = PS00591
MNSYRALMLGLLGGLILTGCGAGQDSPTPGSSSAISSSSESFSSVTSESSSSAISSTASSAPPNYEVPENNFAVNGDVEQGLDNWGAIGGTVSRSTSESRSGAASALITGRTASWNGLTFYVGHLTQGNEYEVAVWVKLASGSPDTTLILTAKRHDDDDPSTFLEYTNIAMATASASNWTLLHGYYTQAGTPFQHFIIESSDDTVSYYADDFSVAGEVEPIAGQGHEFFVGNITTSGNVRSDFIQYWDQITPENEGKWESVERVRGVYDWSGTDRVYAYAREHNIPVKAHAFVWGSQYPSWITSLSPQEQAEAIERWIRDYCARYPDTAMIDVVNEATPDHAPAEFARSAFGENWIIRSFELARQYCPNAILILNDYNVLSWNTEGFINMARPVINAGVVDALGLQAHGLADWSLADIERKLNEVAALGLPIYISEYDIEKTNDQEQLDVMRTQFPLFYNHPSVVGITLWGYVEGRTWRPGTGLIHEDGRHRPAMTWLMDYLGR

SEQ ID NO: 567 - DNA, 1158 bp, Unknown
  Obtained from environmental sample
atgactttttcgcgccggaattttatctggggtactgcggctgttttggccgctacgcaactcaaagcacgcgccttggccgctgcggtggccaacacgggtataaaagatgtgttcaaaggtgacttttttatcggcaccgccatcagcaatgaagcgctggagaagcccgacaccgaacttcttgcgctgatcagtcgagaattcaatgccataaccgctgaaaactgtatgaagtgggagcccattcggccccagttagaccaatggaactgggagttggccgaccgatttgtcgattttggcctaaaaaacaacatgtacgtcgtgggccacacactgatctggcacagccaggcaccggatcacatatatctggacgccgacggcaaacccaacaaccgcttggcgcaactggcggtcatggaagagcacattcgcaccctggcgggccgctacaaaggcaaaatcgacgcctgggacgtggtgaacgaggccgtagaggacgacggcagttggcggcaaaccggctggtatcgcaatgtggggccggaatacgttgcccacgcattccgcctggcggccgaggtagaccccaatgccaagctgctctacaacgactacaacgccgccgtgccgacaaaacgcgaggcgattatttccgttgtcaaaggtatacagcgcgaaaaggcgccgattcacggtgtgggcatgcagggccatatcagcctgagccacccggattttggcgaatttgaaaagtcgattgtcgaatacgccaaactcggcgtaaaagtgcatatcaccgaattggatatcgacgtgctgccgctggcgtggaatttgagcgcagaaatttccaaccgctttgagtaccgaccggaaatggacccctaccgcgacggcctaccagcagaggtggaaaaagccctggccgaccgctacgaagcgctgtttaaaatcctgctgaaacaccgcgacaaagttgaacgcgttaccacctggggcacacacgacggcgaaacctggctgaacggcttccctattcccggccgagtcaactacccgctgctgttcgaccgcaaccagcaaccgaaagaagcctaccaccgcttgattcagctcagacggcaccgccgctaccgaaaccccgcttag

SEQ ID NO: 568 - protein, 385 aa, Unknown
  Obtained from environmental sample
  SIGNAL (1)...(28)
  DOMAIN (34)...(376): Glycosyl hydrolase family 10
  SITE (267)...(277): Glycosyl hydrolases family 10 active site. Prosite id = PS00591
  SITE (285)...(288): N-glycosylation site. Prosite id = PS00001
MTFSRRNFIWGTAAVLAATQLKARALAAAVANTGIKDVFKGDFFIGTAISNEALEKPDTELLALISREFNAITAENCMKWEPIRPQLDQWNWELADRFVDFGLKNNMYVVGHTLIWHSQAPDHIYLDADGKPNNRLAQLAVMEEHIRTLAGRYKGKIDAWDVVNEAVEDDGSWRQTGWYRNVGPEYVAHAFRLAAEVDPNAKLLYNDYNAAVPTKREAIISVVKGIQREKAPIHGVGMQGHISLSHPDFGEFEKSIVEYAKLGVKVHITELDIDVLPLAWNLSAEISNRFEYRPEMDPYRDGLPAEVEKALADRYEALFKILLKHRDKVERVTTWGTHDGETWLNGFPIPGRVNYPLLFDRNQQPKEAYHRLIQLRRHRRYRNPA

SEQ ID NO: 569 - DNA, 1062 bp, Unknown
  Obtained from environmental sample
ttgattcgggctatcgaaagtcttggagaaaacggtcctgagaatctgatcatcaaggccactccctggacaccgcccaacaactggaaaacgggataccctaatgccggactaccagcctatggcggacgcctgaaacatgaacactatgcagattatgccgatgtcctggccgatttcagcctgcagtacgaagccaacatgggccgccctctgaatgtgatttctgtccaaaacgaaccggactatgttcctaccagctatgaatcctgcggctggactgccaatgaaatccgcgattttctaaaaataatgggtccggtattcgcagccaaaaatgtcgatccggacttgcgaatcatggctccggagtccatgcacctgaaagaagccatgatcctgccgaccttgcgcgatccggaagcccgggcagtactggatattgtcggactgcatcagtataaccacgatgaggagttcaatatgggagctatcgagcttccaactgtcaaggagcatggactgccgctgtggcagacagaggtttcgacgggagagcgtaacgaccccagcatcaaggatggagtttactgggccaaattgattcatctggatatgactgttcccgaggtcaatgccttcctgtactggtggttatggtccaccaacaatgattccaagggcaacctgataaacatccgggatggagtacttgagcttaacaaacgcctgtttacaatgggccagttcagccggtttatacgtccgggctgggaacgcgtggaatcggatcatcgcccgataatgggactgtatactaccatgtatcgcaaccccgaaagtgatgagttcgcgttggttatcgtaaacgaacgcaataatccggtcgacctggccatgaatgtggccggagtcgagggttttcaggatcttgaactctggcgaaccagtgccacagaaaacctggaattgcaacgtcgcggtgcgcgggccgaagggaatgttctacaggttcaatcaccggcaatgtcggtatcgactgtatacgggcgggttcagtaa

SEQ ID NO: 570 - protein, 353 aa, Unknown
  Obtained from environmental sample
  SITE (227)...(230): N-glycosylation site. Prosite id = PS00001
MIRAIESLGENGPENLIIKATPWTPPNNWKTGYPNAGLPAYGGRLKHEHYADYADVLADFSLQYEANMGRPLNVISVQNEPDYVPTSYESCGWTANEIRDFLKIMGPVFAAKNVDPDLRIMAPESMHLKEAMILPTLRDPEARAVLDIVGLHQYNHDEEFNMGAIELPTVKEHGLPLWQTEVSTGERNDPSIKDGVYWAKLIHLDMTVPEVNAFLYWWLWSTNNDSKGNLINIRDGVLELNKRLFTMGQFSRFIRPGWERVESDHRPIMGLYTTMYRNPESDEFALVIVNERNNPVDLAMNVAGVEGFQDLELWRTSATENLELQRRGARAEGNVLQVQSPAMSVSTVYGRVQ

SEQ ID NO: 571 - DNA, 1149 bp, Unknown
  Obtained from environmental sample
atgaataattccataaaaattgttctcggtcttatagtgctggtatttctattacccgcttgcagtggtaattcatccgatgataaccttgcactcaagactgtattcgaagatatttttcatattggaacggcattaagcagtaatcagatatacggatatgaccggcagggtatcgaactcacaaaaaaacattttaacacgataactgctgagaatgatacaaaatgggaaaatatccaccctgagccgggagtatttgattttgatgctaccgaccggtttgtcgaattcggtgaaaagcacgatatgtttttggtcggccatacacttgtttggcacagccagacgccccggtgggtttttgaagatgaaaacggaaatactataagccgcgatgcattgcttgaacgaatgcgcgatcatattcataccgtcgtcggccggtacaaaggaagaatgcacggttgggatgtggttaatgaagcgttgaacgaagacggcacgctgcgtgaatctccctggtatcgaattatcggaagggagtacctggtgaaagcattcgagtatgcacgagaagccgatcccgatgcagaactatattacaacgattactcccttgaaaatcccgataagcgggaaggtgcgattcgattggtgagatacctgcaggaacagggtgcacctattaccggaatcggaacgcagggtcactttatgctcgattggcccgagctcgaagagatagaaaaaactatagtcgatttcgccgcgcttggtatcgatgtcatggtgacagaacttgatatcgatgttctgcctcctgcattcgactatcagggtgccgacatcgcaatgcgtgcggagctcgaagaacgcctgaatccgtatcccgacggtctgcccgatgaagtcgatgaagaacttgcccggcgctatcgcgatatattcgaaatttatgtccgacatcgcgagcatataacaagagtgacattttggggcgttaccgacggcaattcatggaaaaataactggccggtacagggaagaacaaattacccgctattattcgatcgcaacgggcagccgaagactgctttttattctgtcgttgaaacggccaatgagttgcttgaggataattattaa

SEQ ID NO: 572 - protein, 382 aa, Unknown
  Obtained from environmental sample
  SIGNAL (1)...(25)
  DOMAIN (31)...(374): Glycosyl hydrolase family 10
  SITE (2)...(5): N-glycosylation site. Prosite id = PS00001
  SITE (24)...(27): N-glycosylation site. Prosite id = PS00001
  SITE (74)...(77): N-glycosylation site. Prosite id = PS00001
MNNSIKIVLGLIVLVFLLPACSGNSSDDNLALKTVFEDIFHIGTALSSNQIYGYDRQGIELTKKHFNTITAENDTKWENIHPEPGVFDFDATDRFVEFGEKHDMFLVGHTLVWHSQTPRWVFEDENGNTISRDALLERMRDHIHTVVGRYKGRMHGWDVVNEALNEDGTLRESPWYRIIGREYLVKAFEYAREADPDAELYYNDYSLENPDKREGAIRLVRYLQEQGAPITGIGTQGHFMLDWPELEEIEKTIVDFAALGIDVMVTELDIDVLPPAFDYQGADIAMRAELEERLNPYPDGLPDEVDEELARRYRDIFEIYVRHREHITRVTFWGVTDGNSWKNNWPVQGRTNYPLLFDRNGQPKTAFYSVVETANELLEDNY

SEQ ID NO: 573 - DNA, 1326 bp, Unknown
  Obtained from environmental sample
gtgaaactggcggcgggtgagcccaatgcggtgatcaaagttacaggtaagcgggaaggcgagagctccagttacgaagagtacgccgaggtggggaccgccctggcaactgccgatagctggaccgaaatcaccggtacctatattccagagagtgccagcccctttgagtactttattatagaaactcaggaaggtgaagccgatgtcagcttttatgtggacgcattttcggtagccggtgaggtgaccgcgcccactccaacacctagtcagccgccagtgacaccgccgtcgggttctggcttggctagtctggtggactttcccgtgggggttgctgtggcggttgccagttttgcgaataacgatttccttaatgattcgcagcaacaggccattgtgcgtgataatttcaatgaaatcgtcgctgaaaatcagatgaagatggaatacttcgaaagtgactactctaatcccagagcagatcaactggtagattgggccagtcagaatggtattcaggttcatggtcacgctctggtttggcacgcgcagccagcagcgtgggtaagcactgccacgggtagtgacttccgccagcgctatgtggatcatgtccgaggagtagcctctcgctacgctggttcggttgtgagttgggatgtggtgaatgaggccttgactgacaatgatgtgtcaccaggtggaaactattaccgccagtcagcattttatgagcagtttggtggccctgaattcattgatatcgcgttccgcgaagcgcgcgaagcggaccccaatgctctgttgtactacaacgattacaacatcgaaaatgggttggataaaaccgacgggctgatagagttgcttgagcggttggttgccaatgatgtacccatcgatggggtagggttccaaatgcacgtcttattggattggccggatatatcgaccatccgagaatcttgggagcgggcgctggcggttcatccagacctgttgctgaaaattaccgaattggatgtacgtatcaataatccctacggtaacaccattgtccactcgaatcgaagtgattgcgacaatggctgtcaagggttcgaattgcaagccgagcgctatcgggaaattatagaagcttatttcgaggtggtgcctccccatcgtcgtggtggtataagcgtctggggtattgcggaccactacagctggtactacacacacgaaggctacgtagactggccgcttatgtgggacagcaacatgcagcctaaacctgcgtatcaagctgtttatgaggcactcagtcaggggcagtag

SEQ ID NO: 574 - protein, 441 aa, Unknown
  Obtained from environmental sample
  DOMAIN (100)...(437): Glycosyl hydrolase family 10
  SITE (128)...(131): N-glycosylation site. Prosite id = PS00001
  SITE (363)...(366): N-glycosylation site. Prosite id = PS00001
MKLAAGEPNAVIKVTGKREGESSSYEEYAEVGTALATADSWTEITGTYIPESASPFEYFIIETQEGEADVSFYVDAFSVAGEVTAPTPTPSQPPVTPPSGSGLASLVDFPVGVAVAVASFANNDFLNDSQQQAIVRDNFNEIVAENQMKMEYFESDYSNPRADQLVDWASQNGIQVHGHALVWHAQPAAWVSTATGSDFRQRYVDHVRGVASRYAGSVVSWDVVNEALTDNDVSPGGNYYRQSAFYEQFGGPEFIDIAFREAREADPNALLYYNDYNIENGLDKTDGLIELLERLVANDVPIDGVGFQMHVLLDWPDISTIRESWERALAVHPDLLLKITELDVRINNPYGNTIVHSNRSDCDNGCQGFELQAERYREIIEAYFEVVPPHRRGGISVWGIADHYSWYYTHEGYVDWPLMWDSNMQPKPAYQAVYEALSQGQ

SEQ ID NO: 575 - DNA, 876 bp, Unknown
  Obtained from environmental sample
atgagtaaaagtaagactaaatggattggaaatatatggtataatggggatacacctactaactttgctgactattggaaccaaataactcctgaaaatgccactaagtgggcgtcatgtgaaccacagcagagtgtatacaatttcaatacagccaaaacaatgtacaattactgtaagtccaatgaaatgcctttcaagttccatacattaatctggggaggacagtatccagattgggtaaacaatctggatactgcaaatagaaaaatagaagttgaaaattggattaaaaatgctggatcaaactttcctaatgcagagttggttgatgttgtaaacgaagctatgccagggcataatccacctagttggaaaaatgacatcggtggtgacaacggtctttatggcactggttgggattgggtagtgtggtcatttgaaaaagcccgcaaatatttccccaattctaagttattgatcaatgactataacgttctttcagattacagcagttgtattgatacatatatcactgtaatcaatatattgaaatctagaggactgattgatggtatcggctgtcaatctcacggtcttgaaaatgtaaatgtcgcaaatgttaagtcaaaactggatagacttgcagctacaggattatcagtgtatatttcagaattagatctcaatattgcagatgatactgcccagaaaaataagatgcaggaactttttcctgtactctatgaacattctgcagtaaaaggcgttaccttatggggttatatacaaggccatacatggatcacaaatagttatctattgcgtagtaacggtacagaaagacctgcgcttacttggctgaagcagtattag

SEQ ID NO: 576 - protein, 291 aa, Unknown
  Obtained from environmental sample
  DOMAIN (1)...(291): Glycosyl hydrolase family 10
  SITE (33)...(36): N-glycosylation site. Prosite id = PS00001
  SITE (222)...(232): Glycosyl hydrolases family 10 active site. Prosite id = PS00591
  SITE (282)...(285): N-glycosylation site. Prosite id = PS00001
MSKSKTKWIGNIWYNGDTPTNFADYWNQITPENATKWASCEPQQSVYNFNTAKTMYNYCKSNEMPFKFHTLIWGGQYPDWVNNLDTANRKIEVENWIKNAGSNFPNAELVDVVNEAMPGHNPPSWKNDIGGDNGLYGTGWDWVVWSFEKARKYFPNSKLLINDYNVLSDYSSCIDTYITVINILKSRGLIDGIGCQSHGLENVNVANVKSKLDRLAATGLSVYISELDLNIADDTAQKNKMQELFPVLYEHSAVKGVTLWGYIQGHTWITNSYLLRSNGTERPALTWLKQY

SEQ ID NO: 577 - DNA, 642 bp, Unknown
  Obtained from environmental sample
atgtttatgttaagtaagaaaattttgatggtgttattaacaatttcaatgagttttattagcttatttacagtaaccgcgtatgcagcttcgacagactactggcaaaattggactgatggtggtgggacagtaaatgctaccaatggatctgatggcaattacagtgtttcatggacaaattgcgggaattttgttgtcggtaaaggctggactaccggatcagcatctagggtaataaactacaatgccggcgccttttcgccgtccggtaatgggtatttggctctctatgggtggacgagaaactcactcatagaatattacgttgttgatagctggggtacttatagacctactggaacttataagggcactgtgactagtgatggggggacatatgacatatatacgactacacgaactaacgcaccttccattgacggaactgcaacttttacccagttctggagtgtaaggcagtcgaagagaccgaccggtaccaacaacaccattacttttagcaaccacgttaacgcatggaagagtaaagggatgaatttggggagtagttggtcttatcaggtattagcgacagagggatatcaaagtagtgggtactctaatgtaacggtctggtaa

SEQ ID NO: 578 - protein, 213 aa, Unknown
  Obtained from environmental sample
  SIGNAL (1)...(29)
  DOMAIN (29)...(212): Glycosyl hydrolases family 11
  SITE (37)...(40): N-glycosylation site. Prosite id = PS00001
  SITE (46)...(49): N-glycosylation site. Prosite id = PS00001
  SITE (54)...(57): N-glycosylation site. Prosite id = PS00001
  SITE (105)...(115): Glycosyl hydrolases family 11 active site signature 1. Prosite id = PS00776
  SITE (171)...(174): N-glycosylation site. Prosite id = PS00001
  SITE (200)...(211): Glycosyl hydrolases family 11 active site signature 2. Prosite id = PS00777
  SITE (212)...(215): N-glycosylation site. Prosite id = PS00001
MFMLSKKILMVLLTISMSFISLFTVTAYAASTDYWQNWTDGGGTVNATNGSDGNYSVSWTNCGNFVVGKGWTTGSASRVINYNAGAFSPSGNGYLALYGWTRNSLIEYYVVDSWGTYRPTGTYKGTVTSDGGTYDIYTTTRTNAPSIDGTATFTQFWSVRQSKRPTGTNNTITFSNHVNAWKSKGMNLGSSWSYQVLATEGYQSSGYSNVTVW

SEQ ID NO: 579 - DNA, 1158 bp, Unknown
  Obtained from environmental sample
atgataatttcaaagaagaatttagttagaggatccattatcggattaattccgattgtaatattcatgttggcatatgatatggatggagtaagtaatgactatcccgctctgagggaagtattcggagatgcaatattaatcggaacagcacttaataatgcacagatatataatcaggatcgtcgcggtatcgaacttgtgaaaaaacattttaattccattaccccggagaatgttacaaagtgggagtttattcatcctcaatcaggtgtctataatttcgatgcagcagatcgatttgttgaattcgggaagaagaacgacatgtttatggttggtcacacgcttgtatggcatagtcagactccccgttgggtttttgaagatgaagatggaaatccacttgatcgcgacgcattattagatcggatgcgcgagcatattcatactgttgtgggaagatataagggaagaattcatggctgggacgttgtaaatgaagctttaaatgatgacggtacattgagggagtcaccatggtatcgtattatcggagaagattatctcctcaaggcatttgaatatgcacatgaagcggaccctgatgctgaattatactataatgattactcattggagaatcccgaaaaacgtgaaggagctgtacgattagtccgctatttacaggagcaaggagcgccgattaccggaatcgggacgcagggacattacatgcttgattggcccgaccttcatgaaattgaaaaaacgataactgattttgccgctcttggtatagatgtgatgataacagaacttgatattgatgttcttcctcctgcatttggatatatgggagccgatatttcggttcgcgccgagttggaggagcagcttaatccatatcccgatggattacccgatgaggttcaagaagagcttgcacagcgctatcgtgatatttttgaagttttcctcaagcatagtgatgtgataacaagagtcacattctggggtgtaaccgacggggattcatggaaaaataattggccagtccggggaagagcgaattatcctctgctgttcgatcgtgaatggcagccaaagcctgcattcttttcggtaatagaattggttcaggttgatccggaataa

SEQ ID NO: 580 - protein, 385 aa, Unknown
  Obtained from environmental sample
  DOMAIN (37)...(380): Glycosyl hydrolase family 10
  SITE (80)...(83): N-glycosylation site. Prosite id = PS00001
  SITE (270)...(280): Glycosyl hydrolases family 10 active site. Prosite id = PS00591
MIISKKNLVRGSIIGLIPIVIFMLAYDMDGVSNDYPALREVFGDAILIGTALNNAQIYNQDRRGIELVKKHFNSITPENVTKWEFIHPQSGVYNFDAADRFVEFGKKNDMFMVGHTLVWHSQTPRWVFEDEDGNPLDRDALLDRMREHIHTVVGRYKGRIHGWDVVNEALNDDGTLRESPWYRIIGEDYLLKAFEYAHEADPDAELYYNDYSLENPEKREGAVRLVRYLQEQGAPITGIGTQGHYMLDWPDLHEIEKTITDFAALGIDVMITELDIDVLPPAFGYMGADISVRAELEEQLNPYPDGLPDEVQEELAQRYRDIFEVFLKHSDVITRVTFWGVTDGDSWKNNWPVRGRANYPLLFDREWQPKPAFFSVIELVQVDPE

SEQ ID NO: 581 - DNA, 1593 bp, Unknown
  Obtained from environmental sample
atgagtatcaggaattttttcacagcaactgttatacttgttgctttgggggcttctctgacctggggtcagacgtggaccagaagtacaattcaaaacgttaatggcattgactacgagctctggaatcaatacgaacggggcacggtcaatatgagaatcacgggtgacggaagctttgaggcttcgtggcaaggaacgtttaatgttcttttccgttccggcagaaaatggggctcttcaagtaccacgactgccgcatccctcaatggcattacctatgattatgctgcaacctggaattccaccgacaatgtgaaaatgctgggtgtgtatggctgggcttattaccctgcgggagcttcaccggcaaacttctctaaccaaattgaatactacatcattcaagaccgtggcagttggaatccggcctccggagccaccaacgcaagaaagatgggcgagggaaccattgacgggattgtgtatgaattttgggtcggcgacagaatcaatcaacccatgctcaccggcgatggcaatttcaagcaatacttcagtgtgcccaagaacacccgcgatcaccgaaccagtggagtcattgacgtggccaggcactttcaggcgtggcacgataacggcatgcgcatgatggattgcccgctttatgaaattgccatgaaggtggaatcttttaccggtgatgcgggaaatagcagcggtagtgctacagtctcacgggctatactcaccctcggtggtggcacgaacccaggtggtggcactaccccggttcagcacacactcacaaccaatgtttctcccgccagttccggtaccgtgaccagaagcccaaacaccaatacatacgctccgaatgcatctgttcagctcaccgctactcccaactccggctggagatttgtaggttggagtggtgatgcctccggttctgccagccccaccaccgtaaccatgagcgaaaatcgcacagttaccgcacggttcgaactcatatccggtgaaagtaccagcaacctgattcaagatggcgatttctccgcaggcagtgtcataagctccgatgaaggcgcttcatggagactcgggcagggacaatactggggaaattctgcagctacatcaagtgtgagcaatggaactgctactatcaatgttacaaccattggggcagaagcctatcagccacaacttgttcaatatggagtccctcttgatgcagacatgatctacaagctttcttttaccgcaagagcggcaacggccaggtctattgaagtcgcatttcagcaggcgacagaaccatgggccaattatgcatccactgagtttgacttaaccacctctgatcgggaatacgagttcgtattcaccatgacccaagcaactgatccagcagcacagttcgcattcaacctgggtcaggcaaccggtaatgtccatataagcgatgtaaaactggtacatacggctgccggtacaacatcaatatcgaacaacatcaacaccgggaacaaagcatttgtttcgatgcacgacagaatgttaagtatcgcagcgcctgtcgaagga

SEQ ID NO: 582 - protein, 531 aa, Unknown
  Obtained from environmental sample
  SIGNAL (1)...(23)
  DOMAIN (32)...(247): Glycosyl hydrolases family 11
  DOMAIN (345)...(497): Carbohydrate binding domain
  SITE (102)...(105): N-glycosylation site. Prosite id = PS00001
  SITE (126)...(129): N-glycosylation site. Prosite id = PS00001
  SITE (241)...(244): N-glycosylation site. Prosite id = PS00001
  SITE (297)...(300): N-glycosylation site. Prosite id = PS00001
  SITE (334)...(337): N-glycosylation site. Prosite id = PS00001
  SITE (391)...(394): N-glycosylation site. Prosite id = PS00001
  SITE (398)...(401): N-glycosylation site. Prosite id = PS00001
MSIRNFFTATVILVALGASLTWGQTWTRSTIQNVNGIDYELWNQYERGTVNMRITGDGSFEASWQGTFNVLFRSGRKWGSSSTTTAASLNGITYDYAATWNSTDNVKMLGVYGWAYYPAGASPANFSNQIEYYIIQDRGSWNPASGATNARKMGEGTIDGIVYEFWVGDRINQPMLTGDGNFKQYFSVPKNTRDHRTSGVIDVARHFQAWHDNGMRMMDCPLYEIAMKVESFTGDAGNSSGSATVSRAILTLGGGTNPGGGTTPVQHTLTTNVSPASSGTVTRSPNTNTYAPNASVQLTATPNSGWRFVGWSGDASGSASPTTVTMSENRTVTARFELISGESTSNLIQDGDFSAGSVISSDEGASWRLGQGQYWGNSAATSSVSNGTATINVTTIGAEAYQPQLVQYGVPLDADMIYKLSFTARAATARSIEVAFQQATEPWANYASTEFDLTTSDREYEFVFTMTQATDPAAQFAFNLGQATGNVHISDVKLVHTAAGTTSISNNINTGNKAFVSMHDRMLSIAAPVEG

SEQ ID NO: 583 - DNA, 1362 bp, Unknown
  Obtained from environmental sample
atggtaaaattaaaattaaaattaaaaaacttattacttgttatttctatcttaaccttaataggtaataatgtttttagtcaaccaccggccgacggtgcgaacaaatttgttggtaatatcaccacaaattatcagattcgtcccgattttaacacgtactggaatcagattaccggtgaaaatgagcataaatggagttctgttgagggaacacgcggcatgtatgactggactgcaggtgaccggattgctaattatgcgagggaacatggtattccatggagatttcacactctgatttggggaagccagtacccagggtggatggacaatctctcccagcaggaacaattagcatcaatcactgcatggatggacgcagcggcagcgcggtatcctgatgtagagatgatcgatgtagtaaacgaagctcttgatggtggaggcgtaagacacgcgcccccgctaacatggaaagacgctctgggtggtgatggagcctcagggtacgactgggtaatcactgcgttcagaatggcccgtgagcgttggcccaatgccattttaaaatataatgattataacataatagaatggggtaataatattgcagaagcagaaagattgattggaattttattggcaaacaatgcaccaatcgatgcaatcggagttcaggctcatgatgcctatagaatagagaccaatcaattgagaagtaatatcgataggcttgctgccttcggtctgccgatttttgttactgaatacgatgtacctgaagccaatgacaacagacaacgggaaatcatacaggaacagtttaccatgttctggaaccatcccaaaatagtggggattaccttttggggatatgtactgggagctacctgggttgaaaacacaggccttatgcatccggatggaagagaacgtccggcacttacctggcttaaaaattacatcagagacaacccaaatccaccaaatgatttccctcaccttcttggattgggtggaggagaaccacctccccctcctccactcgtgccgaattcggcacgaggcgcagaacacccgggcgcgcctcgaaacggaacggttcgccgacaacgcagcatctcgggcagacgaacccaccattccagcgggccttttcgagatatgcagcacaggccgcgtcgtcgggaaaaaagcgctgaaatcccgacagagactgcgggaacggtagatcttcacgagccaagacatccatacccaacgctagatctagcgggtatgggagtcaaccggataggggaggatcatcctccccgctcttctcaggcggcgaggactcgggtcagtgcattctcgtag

SEQ ID NO: 584 - protein, 453 aa, Unknown
  Obtained from environmental sample
  SIGNAL (1)...(27)
  DOMAIN (34)...(323): Glycosyl hydrolase family 10
  SITE (40)...(43): N-glycosylation site. Prosite id = PS00001
  SITE (113)...(116): N-glycosylation site. Prosite id = PS00001
  SITE (253)...(263): Glycosyl hydrolases family 10 active site. Prosite id = PS00591
  SITE (371)...(374): N-glycosylation site. Prosite id = PS00001
MVKLKLKLKNLLLVISILTLIGNNVFSQPPADGANKFVGNITTNYQIRPDFNTYWNQITGENEHKWSSVEGTRGMYDWTAGDRIANYAREHGIPWRFHTLIWGSQYPGWMDNLSQQEQLASITAWMDAAAARYPDVEMIDVVNEALDGGGVRHAPPLTWKDALGGDGASGYDWVITAFRMARERWPNAILKYNDYNIIEWGNNIAEAERLIGILLANNAPIDAIGVQAHDAYRIETNQLRSNIDRLAAFGLPIFVTEYDVPEANDNRQREIIQEQFTMFWNHPKIVGITFWGYVLGATWVENTGLMHPDGRERPALTWLKNYIRDNPNPPNDFPHLLGLGGGEPPPPPPLVPNSARGAEHPGAPRNGTVRRQRSISGRRTHHSSGPFRDMQHRPRRREKSAEIPTETAGTVDLHEPRHPYPTLDLAGMGVNRIGEDHPPRSSQAARTRVSAFS

SEQ ID NO: 585 - DNA, 1188 bp, Unknown
  Obtained from environmental sample
gcacgagcagaggagcaatggcgggaagatgcccaagagcggattgaacaaatacgcaaaggcgatctggtggtgcgcgttgtggatggcaacgaggcgcctgtccccaatgttcccgtacatatcgcgatggaacgacatgcttttccgtggggcacatgcgtacaggcagcaagaattagctgcgggcaacctgacaatgaaacataccgcgaaaagttgcttgagttatttaactgtgccgtccttgagaatgatctgaagtggaatgtgtggtatggcgcggccggccccggcttcaaccgggaacaaacccgcaaagcgctgatatggcttcatgaacgtcaattccgcatccgggggcattgccttgtatggccaagctggaaatactttcgccccgagggcgaggaactgcgcacggacttggcggtctttcaaaagcgtgttctggagcacattgacgaactcgccgagtttacccgtgactatgtgtcggagtgggatgtcgttaacgaaccggttcatcacaacgaggttattcgggcgctgggagaagacgccatggtcgaatggttttcccatgcacggcaggcgctcccggattcctgcctgttgttcattaacgaatataacattgtggagccggacaatcctcttgcacgcgcgccatacaaaaagattatccgtaatctgctcgaagcgggcgctcccctggaaggcatcgggttccaaagccatttccacgacccgcctgcgactccggaggaggcgttgcgggtgttcgaccagtttgcggtttttgggttgcccatcgtggtgacggaatttgacataaacacaaaggacgaatgcagacaggcggcatttacccgggactttatgacggcggcgttcagccatcctgcttgttccgggttcctgatttgggggttctgggaaggagcgcattggcgtcccgatgccgcaatgtttcgtaaagactggtcggaaaagcccaatctccatgcctaccgtgacctggtcttcaatgaatggtggaccgatatagaggaaaccacagatgaaaacggcgtcttgtccgtgagagggttcaaaggcgactacacaatcgttgttgacggacaaaagcacgccgccgccattcatgatacgccaacaacaatcgaaatcgtactgtgcgactga

SEQ ID NO: 586 - protein, 395 aa, Unknown
  Obtained from environmental sample
  DOMAIN (40)...(342): Glycosyl hydrolase family 10
  SITE (68)...(71): N-glycosylation site. Prosite id = PS00001
ARAEEQWREDAQERIEQIRKGDLVVRVVDGNEAPVPNVPVHIAMERHAFPWGTCVQAARISCGQPDNETYREKLLELFNCAVLENDLKWNVWYGAAGPGFNREQTRKALIWLHERQFRIRGHCLVWPSWKYFRPEGEELRTDLAVFQKRVLEHIDELAEFTRDYVSEWDVVNEPVHHNEVIRALGEDAMVEWFSHARQALPDSCLLFINEYNIVEPDNPLARAPYKKIIRNLLEAGAPLEGIGFQSHFHDPPATPEEALRVFDQFAVFGLPIVVTEFDINTKDECRQAAFTRDFMTAAFSHPACSGFLIWGFWEGAHWRPDAAMFRKDWSEKPNLHAYRDLVFNEWWTDIEETTDENGVLSVRGFKGDYTIVVDGQKHAAAIHDTPTTIEIVLCD

SEQ ID NO: 587 - DNA, 1095 bp, Unknown
  Obtained from environmental sample
gcacgagctgcggccgaggagtcgaccggtctcgcgcatgcctggcgcgacgcctttcacgtcggtgtcgctgtgagcaaccagacgctggatcagcagctgaccgcgcacctgaatctgatcgcgcgtgaattcagctcgatcacggccgagaacgcgatgaagtggggcgtattgcggccggacggcgtgaactggcgctggcagcgcccggatgcgttcatggacttcgcggccacgcacgatctgtacgtggtcggacatacgctggtctggcattcgcagatacccgccagcgtgttcgcggacgcgaacggcgccccgctcggtcgcgatgcactgctggcgcggatggaggatcacattgacacgctggccggtcgttaccgtgggcgcgtgcatgcgtgggacgtcgtcaacgaggccatcgacgagagtaatggctggcgccgctcaccgtggctgcagatcatcggtgacgactacatggaacaggcgtttcgcatggcgcgcgccgccgatccgcaagcggtcctgctctacaacgactacaacatgcacaacccgcgcaagcgggcgtttctcgtcgacgtgctgcacgattatctggaccggggcgtgcccatcgatggcgtcgggctgcagggtcacctggggctcgagtatccggacatggaggaatgggaacgcagcatcgccacctacgccgagctcgggttggaagtgcacgtcaccgagctggaaatcgacccgctgccgagcccgtacatgatgagcgcggagatttcgaaccgtttcgactactcacccgagaatgatccgtggccggacggcctgcccgacgaagtgcagcagcagctggccgatcgctatgagcaggtgttcagaatcctgctgcgctatcgcgacagcgtgcggcgcgtcaccttctggggtctgcacgacggcatctcgtggaagaacgacttcccgatccgcggtcgcacgaatcatccgctgctgttcgaccgggatctggcgccgaagcctgcttatcatcgcctgcgcacgctacaggccgcggtccagggcgctcagacgagttcgaccgagtag

SEQ ID NO: 588 - protein, 364 aa, Unknown
  Obtained from environmental sample
  DOMAIN (10)...(352): Glycosyl hydrolase family 10
  SITE (27)...(30): N-glycosylation site. Prosite id = PS00001
ARAAAEESTGLAHAWRDAFHVGVAVSNQTLDQQLTAHLNLIAREFSSITAENAMKWGVLRPDGVNWRWQRPDAFMDFAATHDLYVVGHTLVWHSQIPASVFADANGAPLGRDALLARMEDHIDTLAGRYRGRVHAWDVVNEAIDESNGWRRSPWLQIIGDDYMEQAFRMARAADPQAVLLYNDYNMHNPRKRAFLVDVLHDYLDRGVPIDGVGLQGHLGLEYPDMEEWERSIATYAELGLEVHVTELEIDPLPSPYMMSAEISNRFDYSPENDPWPDGLPDEVQQQLADRYEQVFRILLRYRDSVRRVTFWGLHDGISWKNDFPIRGRTNHPLLFDRDLAPKPAYHRLRTLQAAVQGAQTSSTE

SEQ ID NO: 589 - DNA, 1149 bp, Unknown
  Obtained from environmental sample
atgaaaaaaagaatcaccagtattgcaattgtatttgcgcttgtatttggatttggcgtgttgggatgttcttcgaataagcagggagcaaccgccgatactttgggagaggcatttgaaggacttttttacattggcaccgcactgaatacaccgcagatcaccggccaaaaccaggcggcacaagctgtgataaaaaaacacttcaactccattgtagcagagaattgcatgaagagtgcacttattcaaccacaagagggccagtttgatttcagcctgtctgaccagtttattgcttttggccaggaaaatgatatgcacattgtgggccacaccctcatctggcattctcaggccccgaactggttctttgttgacgaaaacggtgatgacgtatcgcctgaggtgttgaaggagcggatgcgtaaccatatttttacacttgctggcagatataaaggccaggtacatggttgggatgtggtaaatgaggccattgtggaagatggttcctggcgcaacagtaagttttatcaaattcttggcgaggactttgtgcgtctggcattcaaatatgcgcatgaagccgatcccgatgccgagttgtattataatgactatgggatggcaatccccggtcgcagagaaggtgtgatcagaatggtaaaagacttgcaggcacaaggcatcaaaattgatggtattgggatgcaaggccatatgcatttggattcacccactatagaagagttcgaagagagtattctggcttttgcggagctcggcgtgaaggtaatgatcacagaactggatgtcagtgtattgccatggcccggtacctttgtaagtgccgatgtggccatgagtgcagaataccaggcggaaatgaacccctatgtagatggactgcctgatgatgtttacgacgttctgcacaacagatatcttgatctcttccaactttttatcaagcaccacgacaaaatttcccgcgttaccacttggggtgtaaatgacggacagtcatggaaaaacaactggccaatcaggggaagggttgactatccgcttttgtttgatcgcaactatgaacccaaaccatttgtatctgaattgatcgatatggccaatgaagccagaagatga

SEQ ID NO: 590 - protein, 382 aa, Unknown
  Obtained from environmental sample
  SIGNAL (1)...(29)
  DOMAIN (34)...(377): Glycosyl hydrolase family 10
  SITE (267)...(277): Glycosyl hydrolases family 10 active site. Prosite id = PS00591
MKKRITSIAIVFALVFGFGVLGCSSNKQGATADTLGEAFEGLFYIGTALNTPQITGQNQAAQAVIKKHFNSIVAENCMKSALIQPQEGQFDFSLSDQFIAFGQENDMHIVGHTLIWHSQAPNWFFVDENGDDVSPEVLKERMRNHIFTLAGRYKGQVHGWDVVNEAIVEDGSWRNSKFYQILGEDFVRLAFKYAHEADPDAELYYNDYGMAIPGRREGVIRMVKDLQAQGIKIDGIGMQGHMHLDSPTIEEFEESILAFAELGVKVMITELDVSVLPWPGTFVSADVAMSAEYQAEMNPYVDGLPDDVYDVLHNRYLDLFQLFIKHHDKISRVTTWGVNDGQSWKNNWPIRGRVDYPLLFDRNYEPKPFVSELIDMANEARR

SEQ ID NO: 591 - DNA, 2094 bp, Unknown
  Obtained from environmental sample
atgttgaaacaaatcggagatcaaacagtgaacctaccactaaataaactaacgcttaaaagctctcttacagcagcagcatgcgttgctgcgatgagcttttcgacggcgaacgcctgtactggcgcacttaataaccaaaacaacgctgtcggtactcacaacggccattattactccttctggaagcaaaccaacaacagtcgtgtaaatgttacctgcggagagcccggctattatcgggctgaatggagcaacgtctttaactgggtcggtggaatcggctggaatccaggcgggccgagaatcgttaattaccgcggtacattcaacagcggcatcaaccggagctcgtcaaactcttatcttgcgctttacgggtggactcgagccccaaatgaagttgagtattacgtagtcgagagttacggctcctacaatcccgcaagctgcggcggtagcggcggtgttgctggcggtggcggtagtggggatggccacaaaggatccgtcacgatcggcggagtggtttacgacttgacgcaatgcacacgaacgaaccaaccatctatttctggaacctccacatttaagcagtttttcagcgtacgccgaaacccactgccatggggccaggttcaaggcaccatcgatgtaggtgcccacttccaagcctgggctaatgccggcatgcaacttggtactgatcatttttacatggtgctcgccagtgagggttatgacggtgggagtaattcccgtggtaactccgagttgtgggtaactgagggcgctggtggcggcggtgctgtcggcggcggagctggcggcggcggcggtgtaggcggaggtggtactacaggttccggttctaacaccctggtagtgcgcgctattggcacctccggctccgagcagctacgagtaaacgcaggcggcagcaccatagccactttgcgtctgtctactagttggcaggatttcactatcaatactaacgccagcggcgacctgaacgttgaactgttcaacgaccaaggcgaaggttacgaagcacgtgtggaatacgtcatagtcaacggcgacacgcgttacgcagaagatcagagctacaacaccagtgcgtgggatggcgtgtgtggtggcggcactaatactcagtggatgcactgcaacggaatgattggcttcggtaatatcaccgggagtggcggtggtaacaccggtggcggtgcgagcccagctccaaccccaacaccacccgctccaggtgatggaggcaatactggcactggcgccaacactatagtggtacgcgcggtaggtacctctggctccgagcagctacgagtaaacgcaggcggcagcgccatagccactttgagcttgtctaccagttggcaggacttcactatcaatactaacgccggcggcgacctgaacgttgaactgttcaacgaccaaggcgaaggttacgaagcacgtgtggaatacgtcatagtcaacggcgacacgcgttacgcagaagatcagagctacaacaccagcgcttggaatggcgagtgtggtggcggcactaatacccagtggatgcactgcaacggaatgattggcttcggtgatatcaccggaagtggcggtgcgagcccagctccaacaccaacgccaacgccaacaccaactccaacaccccctccaggtaatggaggcaatactagcactggcgccaacactattgtggtacgcgcgataggcacctcgggcagcgaacaactgcgcgttaatgtgggcggcagcgcggtacagaccttgagtctttcaacaagttggcaagagttcaccgttaatactaacgccgttggcgatctcaacgtcgagctattcaacgaccggggtcagggctacgaagcacgcgtagagtatgtgatcgttaacggcgacaggcgttactccagggaccaaagctacaataccagcgcatggagtggtgtgtgtggtggcggctctcacaccgagtggatgcattgcaacggtatgatcggtttcggaaacatttctggcaacactggcaacactagcagtacctgcaattga

SEQ ID NO: 592 - protein, 697 aa, Unknown
  Obtained from environmental sample
  SIGNAL (1)...(39)
  DOMAIN (52)...(261): Glycosyl hydrolases family 11
  SITE (67)...(70): N-glycosylation site. Prosite id = PS00001
  SITE (72)...(75): N-glycosylation site. Prosite id = PS00001
  SITE (116)...(119): N-glycosylation site. Prosite id = PS00001
  SITE (338)...(341): N-glycosylation site. Prosite id = PS00001
  SITE (377)...(380): N-glycosylation site. Prosite id = PS00001
  SITE (405)...(408): N-glycosylation site. Prosite id = PS00001
  SITE (521)...(524): N-glycosylation site. Prosite id = PS00001
  SITE (579)...(582): N-glycosylation site. Prosite id = PS00001
  SITE (667)...(670): N-glycosylation site. Prosite id = PS00001
  SITE (694)...(697): N-glycosylation site. Prosite id = PS00001
  SITE (701)...(704): N-glycosylation site. Prosite id = PS00001
MLKQIGDQTVNLPLNKLTLKSSLTAAACVAAMSFSTANACTGALNNQNNAVGTHNGHYYSFWKQTNNSRVNVTCGEPGYYRAEWSNVFNWVGGIGWNPGGPRIVNYRGTFNSGINRSSSNSYLALYGWTRAPNEVEYYVVESYGSYNPASCGGSGGVAGGGGSGDGHKGSVTIGGVVYDLTQCTRTNQPSISGTSTFKQFFSVRRNPLPWGQVQGTIDVGAHFQAWANAGMQLGTDHFYMVLASEGYDGGSNSRGNSELWVTEGAGGGGAVGGGAGGGGGVGGGGTTGSGSNTLVVRAIGTSGSEQLRVNAGGSTIATLRLSTSWQDFTINTNASGDLNVELFNDQGEGYEARVEYVIVNGDTRYAEDQSYNTSAWDGVCGGGTNTQWMHCNGMIGFGNITGSGGGNTGGGASPAPTPTPPAPGDGGNTGTGANTIVVRAVGTSGSEQLRVNAGGSAIATLSLSTSWQDFTINTNAGGDLNVELFNDQGEGYEARVEYVIVNGDTRYAEDQSYNTSAWNGECGGGTNTQWMHCNGMIGFGDITGSGGASPAPTPTPTPTPTPTPPPGNGGNTSTGANTIVVRAIGTSGSEQLRVNVGGSAVQTLSLSTSWQEFTVNTNAVGDLNVELFNDRGQGYEARVEYVIVNGDRRYSRDQSYNTSAWSGVCGGGSHTEWMHCNGMIGFGNISGNTGNTSSTCN

SEQ ID NO: 593 - DNA, 1137 bp, Unknown
  Obtained from environmental sample
  misc_feature (1)...(1137): n = a, g, c or t
gtgaacttgttatcgacattacccattaaaaggtcacttacagcagcagcgtgcattgcagcgatgggcttttccgcggcaaacgcttgtacgggcgcgcttaacaatcagaacaacgcagtaggtacgcacaacggcttctattattcgttttggaagcagttcaatgacaatagagtgaatattacctgcggagaacccggctattataggacggaatggaacaacgtctttaactgggttggtggaatgggctggaacccaggtgggccgagaatcgttaattaccgtggcacattcaacagtggccgcgcccggaactcgtcaaactcttatcttgcgctttacgggtggactcgagttccaaatgaggttgagtattacgtcgtcgagagttacggctcctacaatcccgcaagctgcggcggtagcggcggtgttgccggcggtggcggcagtggggatggccataaaggatccgtcacgatcggcggagtggtttacgacttgacacaatgcacacgaacgaaccagccgtctatttctggaacctccacatttaggcagtttttcagcgtacgccgagaccccctaccctggggtcaagtccaaggctccatcgatgtgggtgcccatttccaagcctgggctaatgccggcatgcaacttggcaatgatcatttttatatggtgcttgccactgagggttacgatggtaatagcaattcctctggcaactcggagctgtggataactgagggcgccagcggcggtggcggtggcggtggtggtggtggtggnnnccaccaccaagctgtggttccgtgggtggtgttcccgtttgctgccatatcagcgccgacgagaatggcgatggcatgggtatggaaaacggcagtgtgtgtaccgtcacgcaaaataccgaaggctggcacccacccaacccgtctgatgtgctggcagcgatcaacgttggcggtactggcccggcagtgcagatcggcaatgtgtactacgcacccaacacccacgtcaccgggggcacaccgcactctacgacggccactattcaaggcaataacagtgacatctataagtcagagatctacggggatttcactgtctctattcccatga

SEQ ID NO: 594 - protein, 378 aa, Unknown
  Obtained from environmental sample
  SIGNAL (1)...(29)
  DOMAIN (42)...(247): Glycosyl hydrolases family 11
  SITE (61)...(64): N-glycosylation site. Prosite id = PS00001
  SITE (108)...(111): N-glycosylation site. Prosite id = PS00001
  SITE (245)...(248): N-glycosylation site. Prosite id = PS00001
  VARIANT (1)...(378): Xaa = Any Amino Acid
MNLLSTLPIKRSLTAAACIAAMGFSAANACTGALNNQNNAVGTHNGFYYSFWKQFNDNRVNITCGEPGYYRTEWNNVFNWVGGMGWNPGGPRIVNYRGTFNSGRARNSSNSYLALYGWTRVPNEVEYYVVESYGSYNPASCGGSGGVAGGGGSGDGHKGSVTIGGVVYDLTQCTRTNQPSISGTSTFRQFFSVRRDPLPWGQVQGSIDVGAHFQAWANAGMQLGNDHFYMVLATEGYDGNSNSSGNSELWITEGASGGGGGGGGGGGXHHQAVVPWVVFPFAAISAPTRMAMAWVWKTAVCVPSRKIPKAGTHPTRLMCWQRSTLAVLARQCRSAMCTTHPTPTSPGAHRTLRRPLFKAITVTSISQRSTGISLSLFP

SEQ ID NO: 595 - DNA, 978 bp, Unknown
  Obtained from environmental sample
atggtgcgatcggacacgagacgaacgcggaggttcgcgctgctcgccgtgggcgcgatgctcgcagggctggctgcgcttcccgccgcagcggcgcccgacggcgacttcaggccgccggggctcgacaagcaggacacgctccggtgggttgcgccgaagggcttcaagatcggcacagccgtcgcaggcggtggccaccacgtcgaccagccggtacccgaccccttcaacatggacccggagtaccgcgccttgatcggcaaggagttcaattccgtcacgccggagaaccacctcaagtgggagatggtgcacccggagcagggccagtacgacttcgccccagcggacgaggtgatcgcctacgccctggagcacaagcaggacgtgcgcggacacacgctcgtatggcacagccagaacccggactggctcgaggagggtgacttcaccgcggatgagttgcgcgacatcctgcgcgaccacatccacacggtggtcggtcggtacaagggcaagatccagcagtgggatgtcgcgaacgagatcttcctcggaagcggtgcctggcgcaacacgatctggtaccaggcgctaggtccggactacgtcgctgacgccttccgctgggcccacgaggcggaccccgacgcgctgttgttcctcaacgacttcggcgtggagggcatcaacgcgaagagcaccgcgtactacaacctcatccaacaactgctggaggacggtgtcccggttcatggcttcggcatccagggccacctgagcatccagttcgggttcccaggcaacgtccaggccaacctcgagcgcttcgacgccctcggcatcaagaccgccttcaccgaggtcgacgtacggatgaacctgccagcgagcgggatccgatcgaggcgttgcggtacgagtagtccaatcatggccacccctgcaccggcagccagcggacgcgtgggctga

SEQ ID NO: 596 - protein, 325 aa, Unknown
  Obtained from environmental sample
  SIGNAL (1)...(31)
  DOMAIN (47)...(321): Glycosyl hydrolase family 10
MVRSDTRRTRRFALLAVGAMLAGLAALPAAAAPDGDFRPPGLDKQDTLRWVAPKGFKIGTAVAGGGHHVDQPVPDPFNMDPEYRALIGKEFNSVTPENHLKWEMVHPEQGQYDFAPADEVIAYALEHKQDVRGHTLVWHSQNPDWLEEGDFTADELRDILRDHIHTVVGRYKGKIQQWDVANEIFLGSGAWRNTIWYQALGPDYVADAFRWAHEADPDALLFLNDFGVEGINAKSTAYYNLIQQLLEDGVPVHGFGIQGHLSIQFGFPGNVQANLERFDALGIKTAFTEVDVRMNLPASGIRSRRCGTSSPIMATPAPAASGRVG

SEQ ID NO: 597 - DNA, 1842 bp, Unknown
  Obtained from environmental sample
atggtgcgatcggacaccacacgaacgcggaggttcgcgctgctcgtcgtgagcgcgatggttgccgggatggctgtgctccccgctgcggcggccgacaccgccgcagccgaaggcgccttcgaggtcgagatccgcatggccgggagcggaaccgtctccggcgcgggcagctacaacgccggcgacacggtcgagctgacagcgaccccgaacgagggacatgtctggggcggctggacctcggcggagctggagtggatcggggctcgggtgagctcgttcacgatgcccgaacacgatgtcgtgctcgagacgacgttccgaccccggatggcgtccctgcgcgaggcctacaccgactacttccccgtgggcaacatctggtcgaacgtcggaacgtacgcagcaggttcgccgaactcagagacgatcgctcggcactacaacatcatgactgccgagaaccacatgaagccgaacatgttgctgcccaaccagaacatcaacccgacgactcgcgccttcacgttcaactggaccactgcggacaccttcgtcaaccagacgctcgaccgtggcatgcaggtgcacgggcacgtcctcgtctggcacagtcagacgccagcgcggatcttcagcggcgcgacaggtgggacccgtgcgctcgccaaggacaacatggagcgctacatcgaggcggtcctcacgcacttccgtgaccgcgtcgtgtcatgggacgtcgtgaacgaggcgttcatcgacgagatctcggagttcgatccggagaccgaggactggcgcgactatctgcgtggcggccctcgcggcggttcgtccggctggtacacggcctacgggaacggcgccgacgtcgaggccggggaacacccgagcgacttcctctacgacgccttcgtgctcgcccggaagcacggcccggaggtcaagctcgagtacaacgacttcaacttcttccagtccgagggcaaggccaaggcgatcatcgccatggccctcgaactcaacgagcgctacgcggccgagtaccccgacgaccagcgcccgctcatcgaggggctgggcatgcagtcgcacaactacatcaaccagacgccggccttcgcctgctcggacctcacccgactgcccgagctcgtcgacgacgcggtcgaggagtggaagcccggcgcgtgctcgaacttcgcctcggtcgagcgctcgatccagctgatcatcgaggctggcttcagtgtcgccgtcagcgagctcgacgtgcaggtctgggaagcgtggaacgccgagcccgacggcacgagcgcggccgcgtaccgcgacctgaccgacccgtcggtcaaggaccgcttctcccgtggtccattcacctactgggtcggcaagatcaccaaccgggccgagctggaggcgatccaggcgcagcggtacgccgagtatttcgcggtctacaggaagtactcgcaggacatcgatcgggtgaccttctggggcctgaccgacttcctcaactggcggaggaaccacaacccgcagctcttcaaccgcgacttctcggagaagctcgcagcagtcgccaccgccgaccctgagggctggctgggcctccgcaggccggtgaccgacacctccacgcttcgtcagaccatcgcagaggtcgacgcgatgaacctgcgcggccacacctacaccgggcgcagcatcggcgcggtgctgggtgcccgaggacaggccatcgcagtgctggcccgtggtggcacccaggccgaggtgaacgcggcgaacgccgccctcgtcgacgcgatggcagcgctcgaacggaggtag

SEQ ID NO: 598 - protein, 613 aa, Unknown
  Obtained from environmental sample
  SIGNAL (1)...(31)
  DOMAIN (114)...(536): Glycosyl hydrolase family 10
  SITE (181)...(184): N-glycosylation site. Prosite id = PS00001
  SITE (190)...(193): N-glycosylation site. Prosite id = PS00001
  SITE (422)...(432): Glycosyl hydrolases family 10 active site. Prosite id = PS00591
MVRSDTTRTRRFALLVVSAMVAGMAVLPAAAADTAAAEGAFEVEIRMAGSGTVSGAGSYNAGDTVELTATPNEGHVWGGWTSAELEWIGARVSSFTMPEHDVVLETTFRPRMASLREAYTDYFPVGNIWSNVGTYAAGSPNSETIARHYNIMTAENHMKPNMLLPNQNINPTTRAFTFNWTTADTFVNQTLDRGMQVHGHVLVWHSQTPARIFSGATGGTRALAKDNMERYIEAVLTHFRDRVVSWDVVNEAFIDEISEFDPETEDWRDYLRGGPRGGSSGWYTAYGNGADVEAGEHPSDFLYDAFVLARKHGPEVKLEYNDFNFFQSEGKAKAIIAMALELNERYAAEYPDDQRPLIEGLGMQSHNYINQTPAFACSDLTRLPELVDDAVEEWKPGACSNFASVERSIQLIIEAGFSVAVSELDVQVWEAWNAEPDGTSAAAYRDLTDPSVKDRFSRGPFTYWVGKITNRAELEAIQAQRYAEYFAVYRKYSQDIDRVTFWGLTDFLNWRRNHNPQLFNRDFSEKLAAVATADPEGWLGLRRPVTDTSTLRQTIAEVDAMNLRGHTYTGRSIGAVLGARGQAIAVLARGGTQAEVNAANAALVDAMAALERR

SEQ ID NO: 599 - DNA, 3801 bp, Unknown
  Obtained from environmental sample
atgggtagacagctcaaaaagatcatttctatggtacttgcgtttgctttgctgatcccgatgatgccgatcacggcagcagcggccgcagagatggagaccgtgtatcatgagacctttgccagcggcacgagtgcggctgtgcaatcgggcggggccgatctgtcctatgtgacagataaagtgtttgcaggtaatgcagacggtgcagcgcttcgtgtaagcaaccgcacgaatgattgggatgcggcagatttctcatacgaagctctaggtttgcaggttgggaagacatatacgatcagagtaaccggatatattgatacggatacagcggtgccttctggctcccaagccgttatcaatacggttgaaggccacaactgggcagcaaatgtggatatcgcggctggtcaagcctttacactgacaagagaagatttcacactccctgcgggaagcaatcgtctgcgtcttcaatccaacagtactggcgcagcagtgccattctatattggagagatccagatacttgcaaagaaagaaccagtaactaatgttaccgtgtaccaagagaccttcgcaaccggaacgagcgcagctgtgcagtccggcggagctaatctatcctacgtgacagataaagtatttgcaggcaatgaagacggtgcagcccttcgagtaagcaaccgcacgaatgattgggatgcggcagatttctcatacgatgcgatgggactacaagctggcaaggcatacacgattaaggttgtcggctatgttgatgcggatacagcggtgcctgccggctctcaagcagttatcaatactgtgcctggctatagctgggcagcgaatgtggacatcgctgcagggcaagtcttcacgctgacgaaggaagactacacgcttcctgcgggaagtgatcgtctgcgtcttcaatccaacagtactggcgcggcagtgccattctatattggcgaaatcctgattacagagaagtcgagcgctggcggcggcaatgacggcggtggcgatcaagaggaaccgccaagacctccagcgttgccatttaccactattaccttcgaggatcaaaccatgggcggttttacgggccgtgcaggtaccgagtccctgacgatcacgaacgaagccaaccgtacagaaggcggatcttacgctcttaaggtagagaacagatccaataactggcatggaccttctcttcgcgtggaacaatatgtagacagaggatacgagtatcatgtgtctgcatgggtgaagctgatttccccggagaacgcgcagctgcagctgtctacacaagtgggtgacggaaatagcgcgagctacaacaacattgagcgtaagaccgtcagcacagaggatggctgggttgagcttaaaggaacgtaccgctacaacagtgtcggcggtgaatatttgacgatctacattgagtctccgaacagcgctacggcatcgttctatgttgacgatatcagctttgtcaaaggctcaggacctgtggatattcagcgggatttaactccggttaaggatgtatatgctaatgatttcctgatcggcaacgctgtgtctgccgctgatctggaaggcataagattggagctgctgaagcagcatcataacgtcgttacggcagagaacgccatgaagccttcctatatgcagccaaccaaggggaactttacctttgcgggctcggatgcgatcgtgaacaaggcgcttgcggaaggtctgcaggtgttcggccacgtgttggtatggcatcagcagtcgccggattggatgaacctggatgcagacggcaattatctgagcagagaagaagcgctcgataacctgagaactcacatccgtaccgttatggagcattatggggaccggttgatcggttgggatgtcgtgaacgaggcgatgagagataacccgccgaatccgacagattggaaggcatccctgcgtcaatccgcatggtatcatgcgattggtcctgactacgtggagcaggcgtatctggctgcgcgcgaggtactggatgaaaatccggattggaatgttaagctgtactataacgactataatgatgataatcagaataaggcaacagcgatttaccacatggttaaggatataaatgatcgctatgcggcagctaacaatggcaagctgctaatcgatggcataggcatgcagggtcactacaatatgggcaccaatccggaaaatgtaagactttctctggaacggttcatcaccctaggtgtagagatcagcgtgaccgagctcgatattcaggctggcacgaactctgtgctgacggagcagcaagcgattgcccaaggctatctatacgcgcaattattcaaaatttataaagataacgcagatcatatcgcgcgtgttaccttctgggggcttaacgatgcaaccagctggagagctgcaacgagtccgcttatcttcgacagcaatctgcaggcgaagcctgcctactacgctgtaatcgatccggagaaattcctggccgactacacaccggatcaatccgaggcgaatcgcggcagcgcggtattcggtacaccggtcattgatggaacgatcgatgcgatctggagcgaggctcccgtgctcgacatcaatcgttatcagctcgcatggcaaggagctgcaggcgtagctagagcgctgtgggatcatgagaacctctatgtgctgattcaggttacggatacggagctgaacaaagccaatgcgaacccatgggagcaggattccgttgaaatcttcgtagacgagaataataacaaaacgacattctaccaaaatgatgacgcgcaatacagagtcaacttcgataatgaagcgacctttaatcctgcgagtatagcggaaggctttgaatccgcaacgaaggtgtccggcacgaactatacggttgaggtgaagattcctttcagaaccattacccctgcggtgaataaggaaattggcttagacctgcagatcaatgatgcaacggcaggctcgcgtacgagcgtcgctacgtggaatgatacgacgggcaacgcatatcaagatacttccgtgttcggtgtgcttacattgactgctgaaggcacaaatccaggcacagacccaggaacaggtccaggcaacggcccgggtaacggcaacggtcatggtccaatccataaccctggcaaagcgcaagttacagaagtgacggcaacaatcaccggcggtaaagcaatagctgctgtaagtgatgccagcttcgagtccgcgcttgccaatgccaaagcaggacagctcagcttcatcgtgaagggtgcaggacaatccactaatgtatccttgctgctctcgggcagtcaagtgaaacgtgcggcggatgcggggatcaagaccgtggaggtcaacacaggcttggcaacgctggagctgcctttatcgctcattgcgaagggatcggcagacgtagaggtgaatgtgatccgagtggatgtatccacgttgccggccagcatgcgaagcaaggtaggcagcaatccagtgtttgacttcaacctgattgtgggcggcaagaagatcagcagcttcggcgcaaaccagcaggtgacaatcacttacgcatacactctgcagccgagcgagaagcctggtcaagtagcaagctacttcatagcagacagcggcgagctggaaattgtgaagaatgctcggtttaacccggcgttcggcgtcgttgaatttaaaacgaggaatttctaa

SEQ ID NO: 600 - protein, 1266 aa, Unknown
  Obtained from environmental sample
  SIGNAL (1)...(29)
  DOMAIN (355)...(507): Carbohydrate binding domain
  DOMAIN (519)...(848): Glycosyl hydrolase family 10
  DOMAIN (868)...(1048): Domain of unknown function (DUF1083)
  SITE (77)...(80): N-glycosylation site. Prosite id = PS00001
  SITE (164)...(167): N-glycosylation site. Prosite id = PS00001
  SITE (188)...(191): N-glycosylation site. Prosite id = PS00001
  SITE (211)...(214): N-glycosylation site. Prosite id = PS00001
  SITE (233)...(236): N-glycosylation site. Prosite id = PS00001
  SITE (320)...(323): N-glycosylation site. Prosite id = PS00001
  SITE (392)...(395): N-glycosylation site. Prosite id = PS00001
  SITE (406)...(409): N-glycosylation site. Prosite id = PS00001
  SITE (579)...(582): N-glycosylation site. Prosite id = PS00001
  SITE (758)...(774): G-protein coupled receptors family 1 signature. Prosite id = PS00237
  SITE (775)...(785): Glycosyl hydrolases family 10 active site. Prosite id = PS00591
  SITE (959)...(962): N-glycosylation site. Prosite id = PS00001
  SITE (1001)...(1004): N-glycosylation site. Prosite id = PS00001
  SITE (1042)...(1045): N-glycosylation site. Prosite id = PS00001
  SITE (1143)...(1146): N-glycosylation site. Prosite id = PS00001
MGRQLKKIISMVLAFALLIPMMPITAAAAAEMETVYHETFASGTSAAVQSGGADLSYVTDKVFAGNADGAALRVSNRTNDWDAADFSYEALGLQVGKTYTIRVTGYIDTDTAVPSGSQAVINTVEGHNWAANVDIAAGQAFTLTREDFTLPAGSNRLRLQSNSTGAAVPFYIGEIQILAKKEPVTNVTVYQETFATGTSAAVQSGGANLSYVTDKVFAGNEDGAALRVSNRTNDWDAADFSYDAMGLQAGKAYTIKVVGYVDADTAVPAGSQAVINTVPGYSWAANVDIAAGQVFTLTKEDYTLPAGSDRLRLQSNSTGAAVPFYIGEILITEKSSAGGGNDGGGDQEEPPRPPALPFTTITFEDQTMGGFTGRAGTESLTITNEANRTEGGSYALKVENRSNNWHGPSLRVEQYVDRGYEYHVSAWVKLISPENAQLQLSTQVGDGNSASYNNIERKTVSTEDGWVELKGTYRYNSVGGEYLTIYIESPNSATASFYVDDISFVKGSGPVDIQRDLTPVKDVYANDFLIGNAVSAADLEGIRLELLKQHHNVVTAENAMKPSYMQPTKGNFTFAGSDAIVNKALAEGLQVFGHVLVWHQQSPDWMNLDADGNYLSREEALDNLRTHIRTVMEHYGDRLIGWDVVNEAMRDNPPNPTDWKASLRQSAWYHAIGPDYVEQAYLAAREVLDENPDWNVKLYYNDYNDDNQNKATAIYHMVKDINDRYAAANNGKLLIDGIGMQGHYNMGTNPENVRLSLERFITLGVEISVTELDIQAGTNSVLTEQQAIAQGYLYAQLFKIYKDNADHIARVTFWGLNDATSWRAATSPLIFDSNLQAKPAYYAVIDPEKFLADYTPDQSEANRGSAVFGTPVIDGTIDAIWSEAPVLDINRYQLAWQGAAGVARALWDHENLYVLIQVTDTELNKANANPWEQDSVEIFVDENNNKTTFYQNDDAQYRVNFDNEATFNPASIAEGFESATKVSGTNYTVEVKIPFRTITPAVNKEIGLDLQINDATAGSRTSVATWNDTTGNAYQDTSVFGVLTLTAEGTNPGTDPGTGPGNGPGNGNGHGPIHNPGKAQVTEVTATITGGKAIAAVSDASFESALANAKAGQLSFIVKGAGQSTNVSLLLSGSQVKRAADAGIKTVEVNTGLATLELPLSLIAKGSADVEVNVIRVDVSTLPASMRSKVGSNPVFDFNLIVGGKKISSFGANQQVTITYAYTLQPSEKPGQVASYFIADSGELEIVKNARFNPAFGVVEFKTRNF

SEQ ID NO: 601 - DNA, 1533 bp, Unknown
  Obtained from environmental sample
atggaaaacaagaaatttgtacgtgcgatctttctgattacgacggcatgttgtctatcggccaatgccgtaggttccgacctgccggcgttgcaggacgtgtttaaggaccattttctgattgggggcgcgtataaccgcaatttagtggttgggcgggacccccgagcggcggagatcgccatcaagcactacaataccgccacctctgagaatgatatgaagtggtctctgatccatcctcagccgaaccaatataactgggagccggcggaccgtttcatggagttctgtgaaaaacacaatatggcgccgatcggccacgcccttgtttggcacagccaggtgccgcgatgggtttttacggacgattcgggaaatactctgacccgcgaggcgctgctggcccgtatgaaggaacatatcacagcggttgccggccggtataaaggacgcatgaagggctgggacgttgtcaacgaggcgttgaacgataacggcaccctacgcaacaccgcttggctgagaatcatcggggagggcaagccggaacagcaatatgatttcatagcaaaagcgttccaatatgcccatgaggccgacccggacgcggagctctattacaatgactataatctttccacctcaagggccaaggcggacggggcggcggccattgtcaagcaccttcaatccaaagggatccgtatcgacggcgtcgggatgcaggtgcacgccggtctgacatggcctactatcgaagaccttgaatacgcgatcaagacgctgtcggcaacgggcgtcaaagtgatggtgacagagctggatattcgcacgcggacacacggccctcaaggcgctgcaatcacccagattaaccgacggaccacggacgatccggatgcggttttgccggaagttcagcagaaactcgccgataaatacgccgagatcttctctgtcctggtcaagcacaaggacgttatcccgcgtgtcacgttctggggtgttcatgatgggatgtcgtggatcggcggctcacctttgctctttgacagcgattatcagcccaagcaggcctttcacgcagtgctcaacgtcgttcgcggcgacagttccggtcaggcccaatcggcgcgcaaccccgtcatctgggccgatgttccggatgtcgcggccattcgcgtcggcgacacctactacatggccagcaccaccatgcacatgagtcccggcttgcccatcatgaaatcgaagaacctggtcaactgggaattggtcggttatgcctacgacaccctggccgacaaccaggccctccggttggaaaacggccgaaacgcctacggtcggggctcctgggcgcccagcctgcgctaccacaacgggaccttctatgcatcgaccttttccgccacgagcggtcgaacacacatctataccactgcggacattgagaagggtccgtggaaagaaatatcattttccccttcgatacacgatcattctctgttcttcgatgctcgtgccgaa

SEQ ID NO: 602 - protein, 511 aa, Unknown
  Obtained from environmental sample
  SIGNAL (1)...(23)
  DOMAIN (30)...(368): Glycosyl hydrolase family 10
  SITE (168)...(171): N-glycosylation site. Prosite id = PS00001
  SITE (215)...(218): N-glycosylation site. Prosite id = PS00001
  SITE (271)...(281): Glycosyl hydrolases family 10 active site. Prosite id = PS00591
  SITE (469)...(472): N-glycosylation site. Prosite id = PS00001
MENKKFVRAIFLITTACCLSANAVGSDLPALQDVFKDHFLIGGAYNRNLVVGRDPRAAEIAIKHYNTATSENDMKWSLIHPQPNQYNWEPADRFMEFCEKHNMAPIGHALVWHSQVPRWVFTDDSGNTLTREALLARMKEHITAVAGRYKGRMKGWDVVNEALNDNGTLRNTAWLRIIGEGKPEQQYDFIAKAFQYAHEADPDAELYYNDYNLSTSRAKADGAAAIVKHLQSKGIRIDGVGMQVHAGLTWPTIEDLEYAIKTLSATGVKVMVTELDIRTRTHGPQGAAITQINRRTTDDPDAVLPEVQQKLADKYAEIFSVLVKHKDVIPRVTFWGVHDGMSWIGGSPLLFDSDYQPKQAFHAVLNVVRGDSSGQAQSARNPVIWADVPDVAAIRVGDTYYMASTTMHMSPGLPIMKSKNLVNWELVGYAYDTLADNQALRLENGRNAYGRGSWAPSLRYHNGTFYASTFSATSGRTHIYTTADIEKGPWKEISFSPSIHDHSLFFDARAE

SEQ ID NO: 603 - DNA, 1167 bp, Unknown
  Obtained from environmental sample
atgaagaaaatattaaaaaaattaaaagaaacaagtgtattacactttgtggtaattgcatcaatatttttatcatcctgcggtaatgcagatgtttctgaaaatgatgttccatcactaaaagatgtatttgaagatgcatttttaattggaacagctcttaacgaatcacagatctatggtgaggacaaaaagagtgttgagttgacaaaaactcatttcaatgctataactgctgaaaatgttacaaaatgggaggttatccaccccgaaccgggagtgtataattttgggccaactgatgaacttgtagcatttggcgaagaaaatgatatgtttattatcggtcatacattggtatggcatagccagacgccgcgttgggtttttgaagatgatgaaggcaatcctgttgatcgagatgttttgattgaaaggatgcgcgaccatattcatacggtagttggcagatataaaggaaaaattcacgggtgggatgttgtaaatgaagcattaaatgaagacggtacttggagagaatcgccatggtacaacattataggagaagattatcttgttaaggcttttaaatttgcaagagaagcagaccctgaagcagagctatattacaatgattactctcttgaaaacccagaaaagcttgcaggtgctgtaaggttagtagaatttctccaggaacacgatgcaccaataactggtataggaactcaggggcattggagtgtaaggcacccaacccttgaagaattggaaaacactttaaccgatcttggtaatcttggtatagatgtaatgattaccgaaatggatgtggatgtgcttccggctgcttttcattatcatggtgctgatatatccatgcaagctgaattaagagaagaattaaatccctatcctgatggattacctgaagaagcccagcaagaacttgctgcaagatacagagagttttttgaagttatactcagacaccgtgataacgtaacacgtgtgactttttggggggttactgatggtgattcatggctaaataactggcctgtgagaggaaggacaagttatcctttgctatttgaccgtgaatatgaacctaaatcagcattttattcagtggtagatttagccaaggaagttttggaagattaa

SEQ ID NO: 604 - protein, 388 aa, Unknown
  Obtained from environmental sample
  SIGNAL (1)...(30)
  DOMAIN (39)...(382): Glycosyl hydrolase family 10
  SITE (55)...(58): N-glycosylation site. Prosite id = PS00001
  SITE (82)...(85): N-glycosylation site. Prosite id = PS00001
  SITE (339)...(342): N-glycosylation site. Prosite id = PS00001
MKKILKKLKETSVLHFVVIASIFLSSCGNADVSENDVPSLKDVFEDAFLIGTALNESQIYGEDKKSVELTKTHFNAITAENVTKWEVIHPEPGVYNFGPTDELVAFGEENDMFIIGHTLVWHSQTPRWVFEDDEGNPVDRDVLIERMRDHIHTVVGRYKGKIHGWDVVNEALNEDGTWRESPWYNIIGEDYLVKAFKFAREADPEAELYYNDYSLENPEKLAGAVRLVEFLQEHDAPITGIGTQGHWSVRHPTLEELENTLTDLGNLGIDVMITEMDVDVLPAAFHYHGADISMQAELREELNPYPDGLPEEAQQELAARYREFFEVILRHRDNVTRVTFWGVTDGDSWLNNWPVRGRTSYPLLFDREYEPKSAFYSVVDLAKEVLED

SEQ ID NO: 605 - DNA, 1146 bp, Unknown
  Obtained from environmental sample
atgactttctctcgacggcaatttttgctgcaaacctccgccggcctggcacttttgagcactgctaaaatgcgcgctttcgcccgagcagtggatgaagtgggccttaaagaccattttaaagaccattttcatattggaactgccatcagcagtcgactgatgacggaaatgccggccttttaccgcgacctggttacccgtgaattcaacgccatcaccatggaaaacgacatgaaatgggagcgtctgcatcccaaagaaggccaatgggattgggagattgccgacaaattcgtcaattttggcgaagaaaacgacatgtacattgtcgggcatgttctggtctggcattcacagaccccggattgggtcttccaggattccagaggcaagcccatttctcgcgacgctttgctgaaacgcatgcgccaccagattgaacagatggcgggccgctataaaggccgggtacacgcgtgggatgtggtcaacgaggcggtggacgaggaccaaggctggcgcaaaagcccatggtttaacattattgggcccgagtttatggagcacgccttcaattacgcccacgaagtggaccccgacgctcacctgttgtacaacgactacaatatgcacggtcgggaaaaacgcgaattcgtcctggatttcatcaaaagatacaagaaaaaaggcatcccgatccagggcataggcatgcagggccatgtgggcctaagctttcccgatatcagagagtttgagaaaagcctgcaagcctacgccaaacagggcatgcggatgcacattaccgagctggatatggacgtgttaccggtggcctgggatcacattggcgcagagatttccactgagttcgcctacgccgatgaactggacccctggcccaaagggctgccggaagaagtcgaacaggaatttaccgatcgctacacggctttctttaaactgtttttaaaataccgtgacgatattgagcgagtcaccttctggggaaccggtgatgcggaatcttggaaaaataatttcccggtaagggggcgcaccaactacccactgctgtttgatcgccgataccgcagaaaaccggcctatgatgcggtcgtcgaactgaccaaaaacctttaa

SEQ ID NO: 606 - protein, 381 aa, Unknown
  Obtained from environmental sample
  SIGNAL (1)...(30)
  DOMAIN (35)...(378): Glycosyl hydrolase family 10
MTFSRRQFLLQTSAGLALLSTAKMRAFARAVDEVGLKDHFKDHFHIGTAISSRLMTEMPAFYRDLVTREFNAITMENDMKWERLHPKEGQWDWEIADKFVNFGEENDMYIVGHVLVWHSQTPDWVFQDSRGKPISRDALLKRMRHQIEQMAGRYKGRVHAWDVVNEAVDEDQGWRKSPWFNIIGPEFMEHAFNYAHEVDPDAHLLYNDYNMHGREKREFVLDFIKRYKKKGIPIQGIGMQGHVGLSFPDIREFEKSLQAYAKQGMRMHITELDMDVLPVAWDHIGAEISTEFAYADELDPWPKGLPEEVEQEFTDRYTAFFKLFLKYRDDIERVTFWGTGDAESWKNNFPVRGRTNYPLLFDRRYRRKPAYDAVVELTKNL

SEQ ID NO: 607 - DNA, 1515 bp, Unknown
  Obtained from environmental sample
atgagttttgcaagcgtaaaaaatataactaccgcaggcaaagggttggtcgcgcttttcaccttcgccttgctgttcggaacttcatcggtcaatgcccagacgacgctgacgtccaatgtccagggctctgtggacggttttttctattctttctggaaggatagcggggatgcgtccatgacggtctaccccggtggtcgttacacatcacaatggaacaactcgtccaacaactgggtgggtggtctggggtggaaccccggtggccgcagagttgtgaactattccggtcagtacaatgtggacaattcacaaaactcctatctagcactgtacggttggacccgggatccgctgatcgaatactacgtgatcgaaagctacggttcctataacccgtccaactgcactatcggtcgtcagacttacggcaccttccagagtgatggcgccacttacgagattgttcgctgtcagcgtgtgcagcagccgtccatcgatggcactcagacgttctatcagtatttcagtgtgcgccagccaaagctgggctttggcagtgtcagcggcacgattaccgtgggcaatcactttgatgcctgggcctcggtggggctgaatctgggcaaccacgactatcaggtgatggcgaccgagggttatcaaagcttcggtagctccgacattactgtcagtgaaggagcaggcggtggcccgggtggcggcggtcctggtgcgggtggtcccggtggcggttctaccggctctggcagcaatacactggtggtacgtgctgtgggcacatctggcagtgagcaactgcgagtgaacgtcggcggcagctccgtggcaacgttgagtctgtccagtagctggcaggactataccgtcaacaccaacgccactggcgacatcaatgtcgaactgttcaacgatcagggcccaggctatgaggcgcgcgttgagtacgtgattgtcaacggcgacacccgctatggtgcggatcagagctataacaccagcgcctgggacggcgagtgcggcggtggcagcttcaccatgtggatgcactgtaacggtattcttggtttcggtgacatgaccggtggcggcagtggtggttcttccggtggtggatcgaccggtggaggctctactggcggcggttcttccagtggtggtaacacgctggtggtgcgtgctgttggcacctccggcaacgagcagttgcaggtcaatgtgggtggcaacgctgtcgagaccctgagtctgtccaccagttggcaggagtacaccatcaataccagcgcctcgggagacgtcaacgtccagttgatcaacgaccagggtgaaggctacgaagcgcgtgtcgagtacgtcatcatcaacggtgatacccgctacggtgcggatcagagctacaacacaagcgcctgggacggtgagtgtggcggtggcagcttcaccatgtggatgcactgcgaaggcatactcggttttggtgatatgtaa

SEQ ID NO: 608 - protein, 504 aa, Unknown
  Obtained from environmental sample
  SIGNAL (1)...(33)
  DOMAIN (43)...(232): Glycosyl hydrolases family 11
  SITE (8)...(11): N-glycosylation site. Prosite id = PS00001
  SITE (75)...(78): N-glycosylation site. Prosite id = PS00001
  SITE (96)...(99): N-glycosylation site. Prosite id = PS00001
  SITE (120)...(130): Glycosyl hydrolases family 11 active site signature 1. Prosite id = PS00776
  SITE (138)...(141): N-glycosylation site. Prosite id = PS00001
  SITE (263)...(266): N-glycosylation site. Prosite id = PS00001
  SITE (305)...(308): N-glycosylation site. Prosite id = PS00001
  SITE (345)...(348): N-glycosylation site. Prosite id = PS00001
  SITE (441)...(444): N-glycosylation site. Prosite id = PS00001
  SITE (483)...(486): N-glycosylation site. Prosite id = PS00001
MSFASVKNITTAGKGLVALFTFALLFGTSSVNAQTTLTSNVQGSVDGFFYSFWKDSGDASMTVYPGGRYTSQWNNSSNNWVGGLGWNPGGRRVVNYSGQYNVDNSQNSYLALYGWTRDPLIEYYVIESYGSYNPSNCTIGRQTYGTFQSDGATYEIVRCQRVQQPSIDGTQTFYQYFSVRQPKLGFGSVSGTITVGNHFDAWASVGLNLGNHDYQVMATEGYQSFGSSDITVSEGAGGGPGGGGPGAGGPGGGSTGSGSNTLVVRAVGTSGSEQLRVNVGGSSVATLSLSSSWQDYTVNTNATGDINVELFNDQGPGYEARVEYVIVNGDTRYGADQSYNTSAWDGECGGGSFTMWMHCNGILGFGDMTGGGSGGSSGGGSTGGGSTGGGSSSGGNTLVVRAVGTSGNEQLQVNVGGNAVETLSLSTSWQEYTINTSASGDVNVQLINDQGEGYEARVEYVIINGDTRYGADQSYNTSAWDGECGGGSFTMWMHCEGILGFGDM

SEQ ID NO: 609 - DNA, 1146 bp, Unknown
  Obtained from environmental sample
atgactatttcccgccggaaatttatgtggggcacagctgcactcctggccgccacccagctcaaaacccgcgctctcgccgctgccatggccagcacaggcatcaaggacgccttcaagggcgacttccatatcggcaccgccatcagcaacgctaccctgcaaaaccaggatgccaccatgctggatttgatcaagcgcgaatttaatgcaattaccgctgaaaattgcatgaagtgggagcctattcgcccacagctggatcagtggaattgggagctggccgaccgctttgtggatttcggcgttaaaaacaagatgtatgtggtaggtcacacgctgatttggcacagccaggcgccagcgcacatttatctcgacgccgatggtaagcccaacagtcgcgatgcccagttgaaagtaatggaggagcacatacgtaccctggcgggccgctacaaaggaaagatagacgcctgggacgtggttaacgaagcggtggaggatgatggcagctggcgtcaaaccggctggtacaaaaacatgggtgaagaatatatcgcccatgccttccgcttggcagccgaggtagaccccaatgccaaactgctctacaacgactacaacgaggctgtgcccgccaagcgtgatgcgattattcgggtggtaaaaggcgtgcaaaaggcaggcgcacccattcacggtgtggggatgcaagggcacatgagtctgtcacacccggattttgcggagttcgaaaaatccataatcgaatacgccaagttgggggtgaaggtgcacgttaccgaactggatatcgacgtgttgccactggcgtggaacctgagtgcggaaatttccaaccgctttgaataccgcccggagatggacccttatcgtgaaggtttgcccgccaaagtcgaggaggagctggcggcccgttacgaggcgctgtttacaatcctgctgcgtcatcgcgacaaaattgagcgtgtgaccacctggggcaccaacgactcagagacctggctaaatggcttccccattccggggcgcatgaattacccaatgctgttcgatcgtaacaaccagcccaagttggcctatcaccggctgctggcgctcaaacaaaagaaaaatcagtaa

SEQ ID NO: 610 - protein, 381 aa, Unknown
  Obtained from environmental sample
  DOMAIN (34)...(376): Glycosyl hydrolase family 10
  SITE (51)...(54): N-glycosylation site. Prosite id = PS00001
  SITE (267)...(277): Glycosyl hydrolases family 10 active site. Prosite id = PS00591
  SITE (285)...(288): N-glycosylation site. Prosite id = PS00001
  SITE (343)...(346): N-glycosylation site. Prosite id = PS00001
MTISRRKFMWGTAALLAATQLKTRALAAAMASTGIKDAFKGDFHIGTAISNATLQNQDATMLDLIKREFNAITAENCMKWEPIRPQLDQWNWELADRFVDFGVKNKMYVVGHTLIWHSQAPAHIYLDADGKPNSRDAQLKVMEEHIRTLAGRYKGKIDAWDVVNEAVEDDGSWRQTGWYKNMGEEYIAHAFRLAAEVDPNAKLLYNDYNEAVPAKRDAIIRVVKGVQKAGAPIHGVGMQGHMSLSHPDFAEFEKSIIEYAKLGVKVHVTELDIDVLPLAWNLSAEISNRFEYRPEMDPYREGLPAKVEEELAARYEALFTILLRHRDKIERVTTWGTNDSETWLNGFPIPGRMNYPMLFDRNNQPKLAYHRLLALKQKKNQ

SEQ ID NO: 611 - DNA, 993 bp, Unknown
  Obtained from environmental sample
gtgaatgattcacttcgtctgtgcacagtctatgaccggtttttccccattggcaccgctgtcgacagcggtgtgatccgtacccacagacaactgctgctgcagcacttcaacagcctaacggcggaaaacgacatgaagttcggcatcatccaccccaaggaaaaggagtaccagtttgacaaggccgatgctatcgcagcgttcgctcaagaaaacggctttcgcatgcgcggccacaccttggtgtggcaccagcagacaccggaatggctctttcagggcgcggcagggcaaaccgtgtcgcaggatcagctgctggggcggctgcgcgatcacatcaccaccgtcgttcggcgctatcgcgggcaggtgtactgctgggatgtggtcaacgaagcggtctctgacagcgggggcgaggacttacgccgttcgccgtggttggatatctgcgggcccgactatatcgaacaggcctttgcatgggcgcacgcagccgatccggacgcgcttctgttctacaacgactacaatgcagcgatccccaagaaacgggatcggatcggccggttagtacagcgtctgcagcagaaaggcattcccatccatggggttgggatacagggccactggaatcttgacggtccatctctggaggatatccggacggcggtggaggcgtacgccgcgctgggagtgcaggtacacatcaccgaactggatatgtccgtgtttagctgggatgatcgccgaacagacttagcccagcccacggcggagatgaccgaccgccaggcccagcgctacgcggctttgtttgcgctctttcgggagtatgcagaggtgatcaccaacgtcaccttctggggcccggcggacgatcacacctggctgcacaacttcccggtgcgggggcgcaccaattggccgctgttgtttgatcaccatcatcggcccaaaccggcctttttcgatatcacccgcttctag

SEQ ID NO: 612 - protein, 330 aa, Unknown
  Obtained from environmental sample
  DOMAIN (6)...(328): Glycosyl hydrolase family 10
  SITE (2)...(5): N-glycosylation site. Prosite id = PS00001
  SITE (236)...(246): Glycosyl hydrolases family 10 active site. Prosite id = PS00591
  SITE (290)...(293): N-glycosylation site. Prosite id = PS00001
MNDSLRLCTVYDRFFPIGTAVDSGVIRTHRQLLLQHFNSLTAENDMKFGIIHPKEKEYQFDKADAIAAFAQENGFRMRGHTLVWHQQTPEWLFQGAAGQTVSQDQLLGRLRDHITTVVRRYRGQVYCWDVVNEAVSDSGGEDLRRSPWLDICGPDYIEQAFAWAHAADPDALLFYNDYNAAIPKKRDRIGRLVQRLQQKGIPIHGVGIQGHWNLDGPSLEDIRTAVEAYAALGVQVHITELDMSVFSWDDRRTDLAQPTAEMTDRQAQRYAALFALFREYAEVITNVTFWGPADDHTWLHNFPVRGRTNWPLLFDHHHRPKPAFFDITRF

SEQ ID NO: 613 - DNA, 1146 bp, Unknown
  Obtained from environmental sample
atgactttttctcgacggcaatttttgctgcaaacctccgctgggctggcacttttgagcacggccaaaatgcgcgctttcgcccgagcagtcgatgaagtgggccttaaagaccattttaaagaccattttcatataggcactgccatcagcggccgactaatgacggaaatgcccgctttttaccgcgacttggtcactcgtgaattcaacgccatcacgatggaaaacgacatgaagtgggagcgtctgcatcccaaagaaggccaatgggattgggaaattgccgacaaattcgtgaagtttggcgaagaacacgacatgtatattgtcgggcatgttctggtctggcactcacagaccccggattgggtcttccaggattccagaggcaagcccatttctcgcgacgctttgctgaaacgcatgcgtcatcagatcgagcagatggcgggccgctataagggccgggtacacgcgtgggatgtggtcaacgaggcggtggacgaggaccaaggctggcgcaaaagcccgtggtttaacattattgggccagagtttatggagtatgcctttaattatgcccacgaagtggaccccaaggctcacctgctgtacaacgactacaatatgcacggtcgggaaaaacgcgagtttgtgctggatttcatcaaaagatacaagaaaaaaggcattccgatccagggcataggcatgcagggccatgtgggcctcagctttcccgatatcagcgagtttgagaaaagcctgaaagcctacgccaaacagggcatgcgtgtacacattaccgagttggatatggacgtactgccggtggcctgggagcatagtggagcagagatttccaccaactttgcctattcggatgagttgaacccctggcccaagggactgccggaagaagtcgagcaggaatttaccgatcgctacacggcattttttaaactcttcttaaaataccgcgacgatattgaaagagtcaccttctggggaaccggtgatgcggaatcctggaaaaataattttccggtaagggggcgcaccaactacccactgctgtttgatcgccaataccgcaaaaaaccggcctatcattcggtcgtcgaactgaccaaaaacctctga

SEQ ID NO: 614 - protein, 381 aa, Unknown
  Obtained from environmental sample
  SIGNAL (1)...(30)
  DOMAIN (35)...(378): Glycosyl hydrolase family 10
  SITE (268)...(278): Glycosyl hydrolases family 10 active site. Prosite id = PS00591
MTFSRRQFLLQTSAGLALLSTAKMRAFARAVDEVGLKDHFKDHFHIGTAISGRLMTEMPAFYRDLVTREFNAITMENDMKWERLHPKEGQWDWEIADKFVKFGEEHDMYIVGHVLVWHSQTPDWVFQDSRGKPISRDALLKRMRHQIEQMAGRYKGRVHAWDVVNEAVDEDQGWRKSPWFNIIGPEFMEYAFNYAHEVDPKAHLLYNDYNMHGREKREFVLDFIKRYKKKGIPIQGIGMQGHVGLSFPDISEFEKSLKAYAKQGMRVHITELDMDVLPVAWEHSGAEISTNFAYSDELNPWPKGLPEEVEQEFTDRYTAFFKLFLKYRDDIERVTFWGTGDAESWKNNFPVRGRTNYPLLFDRQYRKKPAYHSVVELTKNL

SEQ ID NO: 615 - DNA, 1875 bp, Unknown
  Obtained from environmental sample
atgattaaaagggcaatttttcttatgacagcggtgctccttttcagtctggcctttttactcccgccgcctgccggcgcggagttgtccggtatgaagattcaagaggatattcctgctctcaaggaagtgttcgccgattgtttcaccatcgggacagccgttgaaccccaccaattgaccggggttcgcagcgacctgctgaagaagcattttaatcacattgtggcggagaatgttatgaaaccagtttcgatccaaccgctggaaggcctcttcaactgggctgaggcggaccggattatccaatatgccagagagaacggaatgactgtgcgttttcatactttggtctggcacagtcaggttccggagtggttttttattgacaaagatggaaacgacatggttctggagacagaccctgttaagaaggaggccaataaagaactgcttctaaaacggctggaagaccacatcacggcgattgccgaaagatacaaggaccaggtggattactgggacgtggttaacgaagttattgaccccgcccggccggacgggatgcgcaacagtgagtggtattatattaccggcaaggattatattgaaacggcctttcgtactgtgcgcagggtagcagggccaaaggccaggttgtatattaacgactacaatactcatgacccggtaaaaagggatttcctttacgaactcgtcaaggaattgctggccaagggagtgccggtcgacggtatcggtcaccagacgcatattaatatccagtcaccgcctgtggcggagattgctgcatcaatagagctctttgcggccttgggtttggataaccaaatcactgagctggatgtaagcatctatttggaccatcggactgcttatgacaaagcgccgccggagcttctcataattcagggctaccgttaccaggaattatttgctgaattccgccggttgaaggactacattagtaatgtgactttttggggtaatgccgacaaccattcgtggcttcacgaccggcctattccccggcgcgacgcacccttgccttttgacgaggactatcaagccaagccggcctactggggaatggtcgacccctccaaactacccgaatcacagcgggggatagaaattttaccgcaaacgccggataccgccgatacagatgagacagtgggtagggttggcccggcgccggctacgggtaatttgattcaaaacggtgaatttgatcagggtggggatgggtggatagtgcaaacccatgaactggccagcgcccagctggaaatagttagtgacgccggcatgtccggacctagggcggcaaagatggcgatcaggagaggcggtgaccttatttggcatgtagagatctatggggcctcagtcgttattgtgacggaattgaatgaaacaagaaagaacctcgccaaaaagatgggggctgatgttgtcctcgatccacgcgaagacgatattctctcttcagtgttgagactgactggcggagacggagcagacatattgctggaaatgtcaggaagtgagtcagcgctgattcaaggtctttcgtgcctcaccaatggtggaatagcttcggtgcttggggtctatccttcttcggtgaccattgatatcaactcgcttcttactttcaaaggcataactgtctacacaataacaggacgaaggatgttcgagacctggcagactgcttctgagcttctgaaacacgaaaggatagacatcaccccggttatcacacatgtgctaccctttgacaggtgggaagaagccatgcgcacgatgatgtccggtgattcgggcaagatcatactggagatttag

SEQ ID NO: 616 - protein, 624 aa, Unknown
  Obtained from environmental sample
  SIGNAL (1)...(27)
  DOMAIN (40)...(375): Glycosyl hydrolase family 10
  DOMAIN (434)...(586): Zinc-binding dehydrogenase
  SITE (284)...(294): Glycosyl hydrolases family 10 active site. Prosite id = PS00591
  SITE (336)...(339): N-glycosylation site. Prosite id = PS00001
  SITE (345)...(348): N-glycosylation site. Prosite id = PS00001
  SITE (486)...(489): N-glycosylation site. Prosite id = PS00001
MIKRAIFLMTAVLLFSLAFLLPPPAGAELSGMKIQEDIPALKEVFADCFTIGTAVEPHQLTGVRSDLLKKHFNHIVAENVMKPVSIQPLEGLFNWAEADRIIQYARENGMTVRFHTLVWHSQVPEWFFIDKDGNDMVLETDPVKKEANKELLLKRLEDHITAIAERYKDQVDYWDVVNEVIDPARPDGMRNSEWYYITGKDYIETAFRTVRRVAGPKARLYINDYNTHDPVKRDFLYELVKELLAKGVPVDGIGHQTHINIQSPPVAEIAASIELFAALGLDNQITELDVSIYLDHRTAYDKAPPELLIIQGYRYQELFAEFRRLKDYISNVTFWGNADNHSWLHDRPIPRRDAPLPFDEDYQAKPAYWGMVDPSKLPESQRGIEILPQTPDTADTDETVGRVGPAPATGNLIQNGEFDQGGDGWIVQTHELASAQLEIVSDAGMSGPRAAKMAIRRGGDLIWHVEIYGASVVIVTELNETRKNLAKKMGADVVLDPREDDILSSVLRLTGGDGADILLEMSGSESALIQGLSCLTNGGIASVLGVYPSSVTIDINSLLTFKGITVYTITGRRMFETWQTASELLKHERIDITPVITHVLPFDRWEEAMRTMMSGDSGKIILEI

SEQ ID NO: 617 - DNA, 1152 bp, Unknown
  Obtained from environmental sample
atgagaacatttatattaatcccgctgatgttgttggtgctcagtgcttgtactaacggacaaaatacagaaccggaaacgttgaaagatgcttttgaaggaaagtttctgataggtgcagcactgaatcacagactttacactggtaacgacatcaaaggagcgtcggcaattaagcagcatttcaattcgattgtggcagaaaactgcatgaaaagcgaaatgattcaaccgcgagaaggagagtttttctttgacaacgccgataagtttgttgatttcggccagcgaaacaatatgttcattgttggacataccctcatatggcattcgcaaattccttattggttttttgtggatgagaatggcaaagatgtttctcccgaagtgcttaccgagcgcatgagaaatcatatccacaccgtggtaacacgctataaaggcaaagtacatggttgggatgttgtgaacgaagcaattctcgacgatggctcattccgtaacagcaaattttatcagattctgggagaagacttcatcaaacttgctttccagtttgcccacgaagccgatcccgatgctgaactgtattataatgattattcgatggctctcgaaggaaaaagaaatggcaccgttaagatggttcaaaacctcattgatcagggagttaaaatcgacggtattggtatgcagggacatatgagcatggatttcccaagttttgaagctttcgagaaaagcatcctggcctttgccaatctcggcgttaaagtgatgattacggagctggacatttcggtattgcctttcccaagttcgaatgtgggtgccgacattgccaatactgctgaatatcaacactcactgaatccttatactgacggattacccgctgaagtttacgaacaatggcatcagcgttatgccgatttcttcagactttttgtgaaacatcaggataaaatcagccgtgtaaccctgtggggcttgagcgatgccgattcgtggaaaaacgactggcctgtaaaaggaagaacagattatcccttgttgttcgatcgtaatactgaacctaaaccgcttgtaaccacacttatcagggaagtggccaaaggagttaaaagtgaaatgattgcagaaattaaataa

SEQ ID NO: 618 - protein, 383 aa, Unknown
  Obtained from environmental sample
  SIGNAL (1)...(20)
  DOMAIN (27)...(370): Glycosyl hydrolase family 10
  SITE (213)...(216): N-glycosylation site. Prosite id = PS00001
MRTFILIPLMLLVLSACTNGQNTEPETLKDAFEGKFLIGAALNHRLYTGNDIKGASAIKQHFNSIVAENCMKSEMIQPREGEFFFDNADKFVDFGQRNNMFIVGHTLIWHSQIPYWFFVDENGKDVSPEVLTERMRNHIHTVVTRYKGKVHGWDVVNEAILDDGSFRNSKFYQILGEDFIKLAFQFAHEADPDAELYYNDYSMALEGKRNGTVKMVQNLIDQGVKIDGIGMQGHMSMDFPSFEAFEKSILAFANLGVKVMITELDISVLPFPSSNVGADIANTAEYQHSLNPYTDGLPAEVYEQWHQRYADFFRLFVKHQDKISRVTLWGLSDADSWKNDWPVKGRTDYPLLFDRNTEPKPLVTTLIREVAKGVKSEMIAEIK

SEQ ID NO: 619 - DNA, 582 bp, Unknown
  Obtained from environmental sample
gagcaacaggtttgtggcagctaccaagtcggacaacattgtggactcacctacgagatctggaccgatagcagctcggcctgcatgaccaacaccgccaacgggtttcgggccatgtggaacgcgggcaatcaaaattacctcgcccggaagggagtccggcctggttcgacctcccctgtggtcacctacagtgccgactacaatcccgacggcaactcctacctgggcgtgtacggctggacgacggacccactcatcgagttttacatcatcgacagctgggggagctggcgtcccccaggcaccgacgaaatcggcaccgtcgacgtgaatggcggaacctaccagatctatcgcagccagcgagtgaaccagccgtccattcagggcaccgcgacgttttggcagtactggagcgtccgcacagaaaggcgcaccagcggaaccattaccgttggacctcacttcgaagcatgggccaccttcggcttgaacctaggtgactttttcgaggtgtccatgctggtcgagggctaccatagctcggggtcagccgacgtgaccgtcgccttccaatag

SEQ ID NO: 620 - protein, 193 aa, Unknown
  Obtained from environmental sample
  DOMAIN (11)...(190): Glycosyl hydrolases family 11
EQQVCGSYQVGQHCGLTYEIWTDSSSACMTNTANGFRAMWNAGNQNYLARKGVRPGSTSPVVTYSADYNPDGNSYLGVYGWTTDPLIEFYIIDSWGSWRPPGTDEIGTVDVNGGTYQIYRSQRVNQPSIQGTATFWQYWSVRTERRTSGTITVGPHFEAWATFGLNLGDFFEVSMLVEGYHSSGSADVTVAFQ

SEQ ID NO: 621 - DNA, 1134 bp, Unknown
  Obtained from environmental sample
atgcagttgagacgatttacaggaggtgcacttatcatggtgctttgtgcaagcgcagcaaagggagaaaatatgacgctgagggatgcgtatgccgatcatttctacatcggtgcagcgatcagtcgacaccagttccgtcccgatcagtccgccgttttggagattacggcgcgtcatttcagtagtattacggctgaaaacgagatgaagtggcgttcgctgaatccggctcccggcgaataccgtttcgagaatgccgacgacttcgtgcggcttggtgttgcgaataacatgtacatcgtggggcatgttcttttctggcataatcagacaccagattggttgttccaagacgacgatggtaatcccgtctcacgcgaagtattgatagagcgcatgcgcgcgcatgtgcgcaggctcgtgcagcgctacggcaaccgcgtgaatgcatgggatgttgttaacgaagcttttaacgacaacggctccttgcgccgtagtcattggacgcgtatcctgggcgacgagtttattgagattgccttccaaattgccgaggaagaactgcccccggatgtcgagctgctttataacgattactccatgacgattccagccaaacgcgatgctgttgtgcgcatggtaaacaatttgaaatccaaaggcattcgcatcgatggcgttggcatgcaggggcactgggcacgcaccaacccaaccatcgcgaatatagagagaagcattcttgcctttgctggaaccggcgtgcaagtacacatcaccgaactcgatatcgacatgctcccgcgccatccccagatgtggacaggcggtgcagacaccatgctccgcctacaacaagaccctgcacttgacccctataccgagggcctctcagatgaaagccagagggcattggcacaacgctatgaaggcatcttctccttgtttttgcagcacagcgatgtgattcgccgtgtaaccttctggggtgtgactgatgcccacacctggctcaataactggccgatacgcgggcgcaccagtcatcccctgctttttgatcggcagggaaatcccaagccggcgtttcatgccatcctcaatcttccgggcaagctagcagactaa

SEQ ID NO: 622 - protein, 377 aa, Unknown
  Obtained from environmental sample
  SIGNAL (1)...(22)
  DOMAIN (26)...(372): Glycosyl hydrolase family 10
  SITE (24)...(27): N-glycosylation site. Prosite id = PS00001
  SITE (164)...(167): N-glycosylation site. Prosite id = PS00001
MQLRRFTGGALIMVLCASAAKGENMTLRDAYADHFYIGAAISRHQFRPDQSAVLEITARHFSSITAENEMKWRSLNPAPGEYRFENADDFVRLGVANNMYIVGHVLFWHNQTPDWLFQDDDGNPVSREVLIERMRAHVRRLVQRYGNRVNAWDVVNEAFNDNGSLRRSHWTRILGDEFIEIAFQIAEEELPPDVELLYNDYSMTIPAKRDAVVRMVNNLKSKGIRIDGVGMQGHWARTNPTIANIERSILAFAGTGVQVHITELDIDMLPRHPQMWTGGADTMLRLQQDPALDPYTEGLSDESQRALAQRYEGIFSLFLQHSDVIRRVTFWGVTDAHTWLNNWPIRGRTSHPLLFDRQGNPKPAFHAILNLPGKLAD

SEQ ID NO: 623 - DNA, 1215 bp, Unknown
  Obtained from environmental sample
atgcacattgtaaagtcgagcgcatatctgcttttggcgtcagtcagcctggccctgagcgcttgttccagtagttccagttcaggttcagagaccagttcgtccagtgccagtagttcgtcggcgccaagtagcactacggtcgagttgacgtttgaaaatctctatgccctggccgatttcccgattgggacagccgtgtctgctgcaaatgaaccttacagcatttttggcgaggagtggggggctgggcagcgggcggttattgaacagcactttagccagatgacgcctggcaatatcatgaaaatgagttacctccaacctcaacggaatgtgtttactttcgatgatgctgacgatttcgtcaactatgcggaatctcagggtataggtgttcatgcgcatgcattggtttggcattcggattatcaggtgcccaattggatgaaaaaccttggccccgaggttaccaaagaggagtggttggaattgattcgggaccatgtgcgctcggtagccgcgcactttgctggtaaggtggacagttgggacgttgtgaatgaagcattcctcgacacaggttatcgggaaggcgggggggatgatggctctttattctatgaaaagatgggtgctgattatattgaggcggcgtttgtcgccgcccgtgaaggtgatccaggggcggatctctactacaacgactttaatatgtcagccaatcaacccaaattgacgcatgtgttgaatatggttgaagattttcaggagaaaggaattcccatagatggcattggatttcaaatgcatgtgtacatggattggccgagtattgcggacattagaactagctttcagcgagctgcaagcactggcttgaaagtgaaaattacggagctggacattcccattaacaatccctacgatggcagctataagtatcccgataactattatgcggtattgacacctgaactcgctgctcaacagaagcgccgttattgcgaaattgtagaggtttatctggaagcggtgcccgagggtcagcgtggcggcgtaagtgtgtggggggtattcgaccgggatacttggctggtcaatgcgatatttgaaggcgagcacgatgagtggccgctcttgttcgaccacaatctacaacccaaaccagcggcccaaggtgtcggtgatgcgctgatgggtgaatcctgctaa

SEQ ID NO: 624 - protein, 404 aa, Unknown
  Obtained from environmental sample
  DOMAIN (54)...(399): Glycosyl hydrolase family 10
  SITE (241)...(244): N-glycosylation site. Prosite id = PS00001
  SITE (297)...(307): Glycosyl hydrolases family 10 active site. Prosite id = PS00591
MHIVKSSAYLLLASVSLALSACSSSSSSGSETSSSSASSSSAPSSTTVELTFENLYALADFPIGTAVSAANEPYSIFGEEWGAGQRAVIEQHFSQMTPGNIMKMSYLQPQRNVFTFDDADDFVNYAESQGIGVHAHALVWHSDYQVPNWMKNLGPEVTKEEWLELIRDHVRSVAAHFAGKVDSWDVVNEAFLDTGYREGGGDDGSLFYEKMGADYIEAAFVAAREGDPGADLYYNDFNMSANQPKLTHVLNMVEDFQEKGIPIDGIGFQMHVYMDWPSIADIRTSFQRAASTGLKVKITELDIPINNPYDGSYKYPDNYYAVLTPELAAQQKRRYCEIVEVYLEAVPEGQRGGVSVWGVFDRDTWLVNAIFEGEHDEWPLLFDHNLQPKPAAQGVGDALMGESC

SEQ ID NO: 625 - DNA, 1812 bp, Unknown
  Obtained from environmental sample
gtgaacccactaataaatagattagcgcttaaaagctcgcttgcagcagcaacgtgcgttgctgcgatgagcttttcgacagcgaacgcctgtaccggagcacttaacagccaaaacaacgctgttggtactcacaacggctattattactccttctggaagcagaccgacaacggtcgtgtaaatgtcacctgcggagaacccggctattatagtactgaatggagcaacgtttttaactgggtcggtggagtgggctggaatccaggtgggcctagaatcgttaattaccgcggcacattcaacagcggtatgaaccagagctcttcaaactcttatcttgcgctttacgggtggactcgagtcccaaatgaagtcgagtattacgtagtcgagagctacggttcctacaatcccgcaagctgcggcggtggcggcggtgttgctggcggtggtggtagcggggatggccataaaggatccgtcacgatcggcggagtggtttacgacttgacgcaatgcacacgaacgaaccagccatctatttctggaacttccacatttaggcagtttttcagtgtacgccgggaccctctgccttggggccaggtccaaggctccatcgacgtgggcgcccatttccaagcctgggctgatgccggcatgcaacttggcgatgatcatttttacatggtgctcgccagtgagggttatgatggtgggaataattcttctggtaactccgagctttggataactgagggttctggcggcggtgcagcgcctggtggcggcggcgcaggaaacggcggcgtagtaggaggtggtactacaggttccggttctaacaccctagtagtgcgcgctattggcacctctggctccgagcagctccgagtcaacgcaggcggcagcgccataaccactttgagcttgtctaccagctggcaggatttcacaatcaatactgacgccagcggcgacctgaacattgaactgttcaacgatcaaggcgaaggttacgaagcacgtgtggaatacgtaatagtcaatggtgacactcgatacgcagaagatcaaacctataacacaagtgcctgggacggcgaatgtggcggtgcatctaacacccaatggatgcactgtgacggcatgatcggtttcggtgacatttctggcggcggcgccagtagtccagcgcccggcggtggcggtgccagcccatctccagctcctggtgacagcacaggtggtggcagttccggcacaggttccaacacactcgtgatacgtgcggttggcacctctggcaacgagcaactgcgcgtcaacgtcggaggtagtgcggtggacacccttagcttgtcaaccagctggcaggaatttaccgtgaataccaacgcctctggcgatatcaatgtcgagctgttcaacgaccaaggtgaaggctacgaagcacgtgtagagtatgtgatggtcaacggcgacacgcgttatgccaacgagcagagctacaataccagcgcttgggatggtgaatgtggcggtggctccaatacttattggatgcactgcaatggcatgattggattcggtgatatgtcaggcaatggcggcggcagcgctggcggtgggaataccggcggcaacgcacctggagccgggaatggcggcgctaacaccggcggcggctcaagcggcacttgcaactggtatggcagcagctttcccatgtgcactagcaccagcaacggttggggttgggagaacaatcaaagctgcatttctcccagtacctgcagctctcagtag

SEQ ID NO: 626 - protein, 603 aa, Unknown
  Obtained from environmental sample
  SIGNAL (1)...(30)
  DOMAIN (43)...(252): Glycosyl hydrolases family 11
  DOMAIN (568)...(596): Cellulose or protein binding domain
  SITE (62)...(65): N-glycosylation site. Prosite id = PS00001
  SITE (107)...(110): N-glycosylation site. Prosite id = PS00001
  SITE (245)...(248): N-glycosylation site. Prosite id = PS00001
  SITE (368)...(371): N-glycosylation site. Prosite id = PS00001
  SITE (474)...(477): N-glycosylation site. Prosite id = PS00001
  SITE (513)...(516): N-glycosylation site. Prosite id = PS00001
  SITE (600)...(603): N-glycosylation site. Prosite id = PS00001
MNPLINRLALKSSLAAATCVAAMSFSTANACTGALNSQNNAVGTHNGYYYSFWKQTDNGRVNVTCGEPGYYSTEWSNVFNWVGGVGWNPGGPRIVNYRGTFNSGMNQSSSNSYLALYGWTRVPNEVEYYVVESYGSYNPASCGGGGGVAGGGGSGDGHKGSVTIGGVVYDLTQCTRTNQPSISGTSTFRQFFSVRRDPLPWGQVQGSIDVGAHFQAWADAGMQLGDDHFYMVLASEGYDGGNNSSGNSELWITEGSGGGAAPGGGGAGNGGVVGGGTTGSGSNTLVVRAIGTSGSEQLRVNAGGSAITTLSLSTSWQDFTINTDASGDLNIELFNDQGEGYEARVEYVIVNGDTRYAEDQTYNTSAWDGECGGASNTQWMHCDGMIGFGDISGGGASSPAPGGGGASPSPAPGDSTGGGSSGTGSNTLVIRAVGTSGNEQLRVNVGGSAVDTLSLSTSWQEFTVNTNASGDINVELFNDQGEGYEARVEYVMVNGDTRYANEQSYNTSAWDGECGGGSNTYWMHCNGMIGFGDMSGNGGGSAGGGNTGGNAPGAGNGGANTGGGSSGTCNWYGSSFPMCTSTSNGWGWENNQSCISPSTCSSQ

SEQ ID NO: 627 - DNA, 3351 bp, Unknown
  Obtained from environmental sample
atgtggaagaagtttaaagtaagtctagcctatgttttgatttctgttttattagtttctcaaggatgggcgatttcttatgctgaagtagccacaacgttagagcagacaacagaatcagtcgttttgtatcaggactttgaagacggccaaactggtggatgggaaagaaagtcatggggaggacaaggagaggtttcagttgatgaggtggatggaaataaagttttggcattcacaaaccgtacatctaaagacagcaacccattgcttaatctaaccagctatattaagccagaccgcgagtacagtatatcactgaagttaagacttggagaaggtactggcaaatatcatttggcatccaaggttgaatcaccaatagtggataataagtacccatggttgacgggagatatagaggttacatctacagagtggacaacatttgaaatattaggatacgaaattgcaagtcaaacaactgagtttctcatttggattgaaccggcaagtgattcagagactggtgaagtttttcctgacatttatattgatgaagtgttaatcacagaaataccaacaaagtctgtaccaaaagaaactgtggtattgtcacaggactttgaagatggtcaaactggtggatgggaaaggaagtcatggggaggccaaggagaggtttcagttggtgaggtagatggaaacaaggttttagcatttacaaatcgttcatctaaagacagccagccattacttaacctaaccagctatataaaggcagaaggaaagtacaatatatcatttaagttaagacttggagaaggtactggtaaatatcatgtggcatccaaggttgaatcaccaatcgcggataataagtacccatggttgacaggggatatagaggttacatctacagaatggacaacatttgaaattttaggatacgaaatagcaagtcaaacaactgagtttctcatttggattgaatcttcaagtgattcagaaacagaagaagtttttccagacatctacatagatgatgtattaatcacagaaataccaacaaagtctgtaccaaaagaaactgtggtattgtcacaggactttgaagatggtcaaaatggtggatgggaaaggaagtcatggggaggacaaggagtagtttcagttgttgaggtagatggaaacaaggttttagcatttacaaatcgttcatctaaagacagccagccattacttaacctaaccagctatataaaggcagaaggaaagtacaatatatcatttaagttaagacttggagaaggtactggtaaatatcatgtggcatccaagattgaatcaccaatcgtggataataagtacccatggttgacaggagatatagaggttacatctacagagtggacaacatttgaaattttaggatacgaaatagcaggtcaaacaactgagtttctcatttggattgaatcatcagatgattctgaaactggtgagatttttcctgatatctacatagatgatgtattaatcatagaaatttctgaagaagatggagataatgatgatgatttagatcaatcaggtatcatatctgactttgaagatggtattggtaattgggtgattagagacagctctggaggcagtatagaggtaacagacgctgacaacaataccgcagatggatctaaaagtttgatggcaactgtgtccacccaatataacggtccaatcctggatgttatgggtaaaatgcataagaaccatagataccatttgtctgcatgggttaaaatggctcccggccaaacatcaacttcattgcgtatcagtgtgcaaagtggagatagcacattcactaacgtatctgctaacgtagttgcaacggatgaacagtgggtggaattgtcaggtaatttcactttggcagttactccaagtatattgaacgcttatgtagaaacagtatcaacacctgctgaacctgtaacattctatatggatgactttgtgatatcttatgttggccctgtagggattaagccagttcaaacagatttgaccccaattaaagatgcttataaagattatttcttgattggtagtgcagttgaagatagagatcttcaaggacctcgtcttgaacttcttaagcatcatcacaatgttgttacagcagaaaatgcaatgaaaccagactatagctatgaccaaaacagaaatttcaactttgatgcggaaaatgctcttgtagcaaaagttgaagaagctgatctgaaattggttggtcacgtgctggtatggcatcagcagatgcctttatggttaagtacggcggaagatggtacgccattaagccgagaggtagctcttgaaaatctaaaaactcatattacgacagtaatggaaaactacggagataaggtgattgcgtgggatgtggtcaacgaagcaatcagagatggtctgactacttcagtaactactgataattggcagttggcactgcgtcaatctcctttgtataatgcaattggtccggattatgtagaacagtcattcttgattgcaaaggaagtactcaagaacaatcctgaatggtcagatatcaagctgtattacaatgattacaacgaagatatccaactcaaatcaacagctatctacagcatggttaaggatattaatgatcgatatgcagcagaaaacaatggagagaagctcattgatggtattggtatgcagtctcactataatgtcaacacaaaccccgaaaatgttcgactttctctggagaaatttatctctttaggtgttgagataagcatcactgaacttgacattactgtaggaagcgattctgagctttctgaatatgatgctattgctcagggctacttatatgcacaattatttaagctctataaggaatatgctgagaatatcgtacgcgtaaccttctggggattggatgacgagacaagctggagaagtgaaggaagcccgttgttattcgatggatatttgcaggctaaaccagcgtactatgctataatggatccagataaattcatagcagagaatccccttgaggtaataggagctaatcaggcgaatgcggtatttggtacacctgtgattgatggtactatagattcagtttggagccaggcccctgagatttctgttaaacagttcctggatgcatggcaaggtgcttctggagttgctaaagctctttgggatgaagaaaacctatatgtactggttcaagttaaagatgatcagcttgacaaaagtcatgtagatccatgggaacaggattctgttgagatccaa

SEQ ID NO: 628 - protein, 1117 aa, Unknown
  Obtained from environmental sample
  DOMAIN (39)...(193): Carbohydrate binding domain
  DOMAIN (201)...(355): Carbohydrate binding domain
  DOMAIN (363)...(517): Carbohydrate binding domain
  DOMAIN (529)...(679): Carbohydrate binding domain
  DOMAIN (693)...(1026): Glycosyl hydrolase family 10
  DOMAIN (1046)...(1117): Domain of unknown function (DUF1083)
  SITE (82)...(85): N-glycosylation site. Prosite id = PS00001
  SITE (93)...(96): N-glycosylation site. Prosite id = PS00001
  SITE (246)...(249): N-glycosylation site. Prosite id = PS00001
  SITE (257)...(260): N-glycosylation site. Prosite id = PS00001
  SITE (270)...(273): N-glycosylation site. Prosite id = PS00001
  SITE (411)...(414): N-glycosylation site. Prosite id = PS00001
  SITE (422)...(425): N-glycosylation site. Prosite id = PS00001
  SITE (434)...(437): N-glycosylation site. Prosite id = PS00001
  SITE (569)...(572): N-glycosylation site. Prosite id = PS00001
  SITE (634)...(637): N-glycosylation site. Prosite id = PS00001
  SITE (652)...(655): N-glycosylation site. Prosite id = PS00001
  SITE (956)...(966): Glycosyl hydrolases family 10 active site. Prosite id = PS00591
MWKKFKVSLAYVLISVLLVSQGWAISYAEVATTLEQTTESVVLYQDFEDGQTGGWERKSWGGQGEVSVDEVDGNKVLAFTNRTSKDSNPLLNLTSYIKPDREYSISLKLRLGEGTGKYHLASKVESPIVDNKYPWLTGDIEVTSTEWTTFEILGYEIASQTTEFLIWIEPASDSETGEVFPDIYIDEVLITEIPTKSVPKETVVLSQDFEDGQTGGWERKSWGGQGEVSVGEVDGNKVLAFTNRSSKDSQPLLNLTSYIKAEGKYNISFKLRLGEGTGKYHVASKVESPIADNKYPWLTGDIEVTSTEWTTFEILGYEIASQTTEFLIWIESSSDSETEEVFPDIYIDDVLITEIPTKSVPKETVVLSQDFEDGQNGGWERKSWGGQGVVSVVEVDGNKVLAFTNRSSKDSQPLLNLTSYIKAEGKYNISFKLRLGEGTGKYHVASKIESPIVDNKYPWLTGDIEVTSTEWTTFEILGYEIAGQTTEFLIWIESSDDSETGEIFPDIYIDDVLIIEISEEDGDNDDDLDQSGIISDFEDGIGNWVIRDSSGGSIEVTDADNNTADGSKSLMATVSTQYNGPILDVMGKMHKNHRYHLSAWVKMAPGQTSTSLRISVQSGDSTFTNVSANVVATDEQWVELSGNFTLAVTPSILNAYVETVSTPAEPVTFYMDDFVISYVGPVGIKPVQTDLTPIKDAYKDYFLIGSAVEDRDLQGPRLELLKHHHNVVTAENAMKPDYSYDQNRNFNFDAENALVAKVEEADLKLVGHVLVWHQQMPLWLSTAEDGTPLSREVALENLKTHITTVMENYGDKVIAWDVVNEAIRDGLTTSVTTDNWQLALRQSPLYNAIGPDYVEQSFLIAKEVLKNNPEWSDIKLYYNDYNEDIQLKSTAIYSMVKDINDRYAAENNGEKLIDGIGMQSHYNVNTNPENVRLSLEKFISLGVEISITELDITVGSDSELSEYDAIAQGYLYAQLFKLYKEYAENIVRVTFWGLDDETSWRSEGSPLLFDGYLQAKPAYYAIMDPDKFIAENPLEVIGANQANAVFGTPVIDGTIDSVWSQAPEISVKQFLDAWQGASGVAKALWDEENLYVLVQVKDDQLDKSHVDPWEQDSVEIQ

SEQ ID NO: 629 - DNA, 1143 bp, Unknown
  Obtained from environmental sample
atgcactctcgccgtaagtttttacttcgctcagctcaagcaacaggcttgatgctgtttgccaaacagcaggcttttgccagcgccgctaaaaaaaccgggcttgccgaggcctttaaagataacttctttgtgggtaccgccatctctaccagcacgctggttaatcaggatgccaccatgctggatattattgcccgcgagtttaacgccattaccgcggaaaactgtatgaaatggggtgttattaatcccgagcccggcgtgtgggactgggagcctgcggaccgtttcgtggactttggcgaaaagcagggtatgtgcgtggtgggtcataccctggtgtggcactcgcaagcacccgcctggttgtttaaagatgacaaaggcgggcaggtgagcgcgacagagctgaatgcgcggatggagcgccatattgaggttttggccggtcgctataaaggcaagattcacacctgggatgtggttaacgaggccattgatgaagataaaggctggcgcaagagcccctggtttaacatcctcggccctgaatttatggagcgtgcctttcatttggcacatcaggttgatccggacagccacctgatttacaacgactacaatatgcataaccccggcaagcgcgagtttttgtttaaggtgttaaaggattatgtaaaacgcggtgtgcccattcatggtgtgggcatgcagggccatgtgggactcgactacccggatatgaccgagtttgaaaacaccatgaaagcgtgtgccgatatgggcttagcgttgcatattaccgagctggatgtggatgtgttgcccgttgcctgggagcatatgggcgcggagatctctaccaactttgcctacagcgacgagcttaacccttatgtggatggcctgcccgacaaggtgcagcagcagctgactgaccgttatgtgcagttgttcgagctgtttttgaagtacgaaaaacacattgcccgcgttaccacctggggcactaatgatgcacagagctggaagaacggtttccctgtgcgcggtcgcactaactacccgttactgtttgatcgcaacaaccagcccaagcctgcttaccatgccattaaggcgttgaaagcgaccccttaa

SEQ ID NO: 630 - protein, 380 aa, Unknown
  Obtained from environmental sample
  DOMAIN (34)...(377): Glycosyl hydrolase family 10
  SITE (267)...(277): Glycosyl hydrolases family 10 active site. Prosite id = PS00591
MHSRRKFLLRSAQATGLMLFAKQQAFASAAKKTGLAEAFKDNFFVGTAISTSTLVNQDATMLDIIAREFNAITAENCMKWGVINPEPGVWDWEPADRFVDFGEKQGMCVVGHTLVWHSQAPAWLFKDDKGGQVSATELNARMERHIEVLAGRYKGKIHTWDVVNEAIDEDKGWRKSPWFNILGPEFMERAFHLAHQVDPDSHLIYNDYNMHNPGKREFLFKVLKDYVKRGVPIHGVGMQGHVGLDYPDMTEFENTMKACADMGLALHITELDVDVLPVAWEHMGAEISTNFAYSDELNPYVDGLPDKVQQQLTDRYVQLFELFLKYEKHIARVTTWGTNDAQSWKNGFPVRGRTNYPLLFDRNNQPKPAYHAIKALKATP

SEQ ID NO: 631 - DNA, 1143 bp, Unknown
  Obtained from environmental sample
atgaacaatctatcccgccgtaaattccttctgggcagcgccggcctggccgcactgaccaatctgaaagcctgcgccatcaacaacgctgtcgagcacaccggactgcacaaggtgtacaaggacgatttcctgatcggtaccgccatcagcaaccagactctggcaacccgcaaccgcccattgctggatctgatcgggcgtgagttcaacgccattaccgccgagaactgcatgaaatccggcctgctgcaaccctcccagggccagtgggaatgggagctggcggatcgttttatcgattacggggtagagaacgacatgcacattgtcggccacgctctggtgtggcactcacaggcacccggcgacttttttgtccacgaagacggtcggcagatttcccgcgccgagctgatccggcgcatggacacccacatccagaccgttatggagcgttacaagggcaaggtgcacacctgggatgtggtcaacgagtccattgacgaagatcagggctggcgcaagagcctgtggtatcaggtcatgggctcggcggagtaccaggagcgggccttcaatctggctcacgagctggaccccaaagcgcacctgatttacaacgactacaacatgcacaaccccggcaaacgggagtttctggtggatgtgatcaaggattacaaaaaacgcggcgtgcccattcacggcgtgggtatgcagagccatgtgggcctggactacccggatatgcgcgaatacgaaaaaagcatcgaagcttacgcggctctgggcatgcgcctgcacatgaccgagctggaagtggatgtgctgccggtagcctgggaacacatgggggcagaaatttccaccgagtttgagtacgccgatgagctcaatccttacactgacggcttgccggcggaagtggagaatgagctgaccgaacgttatgtggagttgttcaaactctatatcaagcaccgggacaagatcgaccggatcaccacctggggcacccacgatggcgaatcctggaaaaacgacttcccggttcgcggccgcaccaactacgccctgttgttcgatcgggatctgcagcccaaagacgcttactacgccctgctcaacctgcgccgctga

SEQ ID NO: 632 - protein, 380 aa, Unknown
  Obtained from environmental sample
  SIGNAL (1)...(26)
  DOMAIN (35)...(379): Glycosyl hydrolase family 10
  SITE (3)...(6): N-glycosylation site. Prosite id = PS00001
  SITE (52)...(55): N-glycosylation site. Prosite id = PS00001
  SITE (167)...(170): N-glycosylation site. Prosite id = PS00001
MNNLSRRKFLLGSAGLAALTNLKACAINNAVEHTGLHKVYKDDFLIGTAISNQTLATRNRPLLDLIGREFNAITAENCMKSGLLQPSQGQWEWELADRFIDYGVENDMHIVGHALVWHSQAPGDFFVHEDGRQISRAELIRRMDTHIQTVMERYKGKVHTWDVVNESIDEDQGWRKSLWYQVMGSAEYQERAFNLAHELDPKAHLIYNDYNMHNPGKREFLVDVIKDYKKRGVPIHGVGMQSHVGLDYPDMREYEKSIEAYAALGMRLHMTELEVDVLPVAWEHMGAEISTEFEYADELNPYTDGLPAEVENELTERYVELFKLYIKHRDKIDRITTWGTHDGESWKNDFPVRGRTNYALLFDRDLQPKDAYYALLNLRR

SEQ ID NO: 633 - DNA, 1398 bp, Unknown
  Obtained from environmental sample
atgagaaagctactaattatctggattgtgctgatactggccctgttgccggttatcagctgtgatgtaattgcaagggtcgaagacccgaccgaagaactggaaaccgacccggtggatgatgacccggcaaatgactcagggccctcccctacagaacctggcagttcaacaagcaacctttttatgagcatggccggtaaatcacaaagtcaggtagactccaaactacagaccgtagtcaaccgtatttttggcatagggactggcgaaagctcaacacccgtccaggaaactggttaccgcttgtattacgaactcccccaggacccatcgatggccttcatctggacggcagatacaaatgatatccgcaccgaaggaatgtcctacggcatgatgattgcagtccagatggacatgcaggaagaattcgacaagctctggaaatttgctaaaacccatatgcagtaccctggcaacatcagtggcgacgacctggaggcctggcgttattatttccgctggtggctgacagacatcaacacctccgatccgagcaactggagctggaacagcgccaacgatacccccgctcccgatggtgaggtatatttcgcaatgtcactgtacctggccgaccgccgctggggctccaacggcacctggaactataaagaagcagccgatcaaatcaccaacgcgatgctcaataaccagcaatccggcatccgctatccaattattcataccgatgaaaataaaatcagctttgtaccatacggaaattcctacggtttttcggatcccagctaccatgttccgcatttttttgaaagcttcgcagcctggggcccatcggaaaacagtgcccgctggatggagatagcccaaatcagccgggattatctggttattgcggctcatgaacaaaccggcttgcatccggactatgcagcctatgacggaaccccggtatccgatgtttccggaacactcagcgatggcctttcggatggcctgcatgacaacttccgattcgattcatggcgtgttcctatgaatatggccatggactatatctggtacggtacggatgagcacatgaaagagcaagtcgtaaaataccatgagtttttcagcgactataaagggacaaacaatgtgacgcaatcactgttcaaaattgatgggacaggtggcagcggaaacggctcaacagctcttactgccactttggctgcagccagcatggcttccgaccaccccgatgctgaattctgggtcgcagccctctgggattgctggcagcaaaatgggacataccgctactatcaacaactggtgtatctattagggatgatgaatgtagcaggaatttatcagaccaactggtaa

SEQ ID NO: 634 - protein, 465 aa, Unknown
  Obtained from environmental sample
  DOMAIN (77)...(459): Glycosyl hydrolases family 8
  SITE (45)...(48): N-glycosylation site. Prosite id = PS00001
  SITE (163)...(166): N-glycosylation site. Prosite id = PS00001
  SITE (184)...(187): N-glycosylation site. Prosite id = PS00001
  SITE (190)...(193): N-glycosylation site. Prosite id = PS00001
  SITE (223)...(226): N-glycosylation site. Prosite id = PS00001
  SITE (393)...(396): N-glycosylation site. Prosite id = PS00001
  SITE (410)...(413): N-glycosylation site. Prosite id = PS00001
  SITE (445)...(448): N-glycosylation site. Prosite id = PS00001
MRKLLIIWIVLILALLPVISCDVIARVEDPTEELETDPVDDDPANDSGPSPTEPGSSTSNLFMSMAGKSQSQVDSKLQTVVNRIFGIGTGESSTPVQETGYRLYYELPQDPSMAFIWTADTNDIRTEGMSYGMMIAVQMDMQEEFDKLWKFAKTHMQYPGNISGDDLEAWRYYFRWWLTDINTSDPSNWSWNSANDTPAPDGEVYFAMSLYLADRRWGSNGTWNYKEAADQITNAMLNNQQSGIRYPIIHTDENKISFVPYGNSYGFSDPSYHVPHFFESFAAWGPSENSARWMEIAQISRDYLVIAAHEQTGLHPDYAAYDGTPVSDVSGTLSDGLSDGLHDNFRFDSWRVPMNMAMDYIWYGTDEHMKEQVVKYHEFFSDYKGTNNVTQSLFKIDGTGGSGNGSTALTATLAAASMASDHPDAEFWVAALWDCWQQNGTYRYYQQLVYLLGMMNVAGIYQTNW

SEQ ID NO: 635 - DNA, 831 bp, Unknown
  Obtained from an environmental sample
gtgaacccactaataaatagattagcgcttaaaagctcgcttgcagcagcaacgtgcgttgctgcgatgagcttttcgacagcgaacgcctgtaccggagcacttaacagccaaaacaactctgttggtactcacaacggctattattactccttctggaagcagaccgacaacggtcgtgtaaatgtcacctgcggagaacccggctattatagtactgaatggagcaacgtttttaactgggtcggtggagtgggctggaatccaggtgggcctagaatcgttaattaccgcggcacattcaacagcggtatgaaccagagctcttcaaactcttatcttgcgctttacgggtggactcgagtcccaaatgaagtcgagtattacgtagtcgagagctacggttcctacaatcccgcaagctgcggcggtggcggcggtgttgctggcggtggtggtagcggggatggccataaaggatccgtcacgatcggcggagtggtttacgacttgacgcaatgcacacgaacgaaccagccatctatttctggaacttccacatttaggcagtttttcagtgtacgccgggaccctctgccttggggccaggtccaaggctccatcgacgtgggcgcccatttccaagcctgggctgatgccggcatgcaacttggcgatgatcatttttacatggtgctcgccagtgagggttatgatggtgggaataattcttctggtaactccgagctttggataactgagggttctggcggcggtgcagcgcctggtggcggcggcgcaggaaacggcggctcgtgccgaattctttgg

SEQ ID NO: 636 - protein, 277 aa, Unknown
  Obtained from an environmental sample
  SIGNAL (1)...(30)
  DOMAIN (43)...(252): Glycosyl hydrolases family 11
  SITE (39)...(42): N-glycosylation site. Prosite id = PS00001
  SITE (62)...(65): N-glycosylation site. Prosite id = PS00001
  SITE (107)...(110): N-glycosylation site. Prosite id = PS00001
  SITE (245)...(248): N-glycosylation site. Prosite id = PS00001
MNPLINRLALKSSLAAATCVAAMSFSTANACTGALNSQNNSVGTHNGYYYSFWKQTDNGRVNVTCGEPGYYSTEWSNVFNWVGGVGWNPGGPRIVNYRGTFNSGMNQSSSNSYLALYGWTRVPNEVEYYVVESYGSYNPASCGGGGGVAGGGGSGDGHKGSVTIGGVVYDLTQCTRTNQPSISGTSTFRQFFSVRRDPLPWGQVQGSIDVGAHFQAWADAGMQLGDDHFYMVLASEGYDGGNNSSGNSELWITEGSGGGAAPGGGGAGNGGSCRILW

What is claimed is:

1. An isolated, synthetic or recombinant nucleic acid comprising:
   (a) a nucleic acid of SEQ ID NO: 383;
   wherein the nucleic acid encodes a polypeptide having a xylanase activity
   (b) the nucleic acid of (a), further comprising modification of the nucleotides at residues 40 to 42, wherein the nucleotides are modified to CAC or CAT and wherein in the nucleic acid encodes a polypeptide having a xylanase activity, or
   (c) a nucleic acid encoding a polypeptide having a xylanase activity, wherein the polypeptide comprises the sequence of SEQ ID NO: 384.

2. The nucleic acid of claim 1 further comprising at least one modification selected from the group consisting of:
   the nucleotides at residues 10 to 12 are modified to CCT, TTA, TTG, CTC, CTA or CTG,
   the nucleotides at residues 25 to 27 are modified to CCC, CCG, CCA or CCT,
   the nucleotides at residues 28 to 30 are modified to TCA, TCC, TCT, TCG, AGT or AGC,
   the nucleotides at residues 37 to 39 are modified to TTT or TTC,
   the nucleotides at residues 37 to 39 are modified to TAC or TAT,
   the nucleotides at residues 37 to 39 are modified to ATA, ATT or ATC,
   the nucleotides at residues 37 to 39 are modified to TGG,
   the nucleotides at residues 52 to 54 are modified to TTC or TTT,
   the nucleotides at residues 73 to 75 are modified to GAG or GAA,
   the nucleotides at residues 73 to 75 are modified to CCC, CCG, CCA or CCT,
   the nucleotides at residues 88 to 90 are modified to GTG, GTC, GTA or GTT,
   the nucleotides at residues 100 to 102 are modified to TGT or TGC,
   the nucleotides at residues 100 to 102 are modified to CAT or CAC,
   the nucleotides at residues 100 to 102 are modified to TTG, TTA, CTT, CTC, CTA or CTG,
   the nucleotides at residues 103 to 105 are modified to GAG or GAA,
   the nucleotides at residues 103 to 105 are modified to GAT or GAC,
   the nucleotides at residues 211 to 213 are modified to ACA, ACT, ACC or ACG,
   the nucleotides at residues 211 to 213 are modified to TGT or TGC, and
   the nucleotides at residues 508 to 582 are modified to CAT or CAC, wherein said nucleic acid encodes a polypeptide having xylanase activity.

3. An expression cassette, a vector or a cloning vehicle comprising the nucleic acid of claim 1, wherein the cloning vehicle comprises a viral vector, a plasmid, a phage, a phagemid, a cosmid, a fosmid, a bacteriophage or an artificial chromosome, wherein the viral vector comprises an adenovirus vector, a retroviral vector or an adeno-associated viral vector, or, the artificial chromosome comprises a bacterial artificial chromosome (BAC), a bacteriophage P 1-derived vector (PAC), a yeast artificial chromosome (YAC), or a mammalian artificial chromosome (MAC).

4. A transformed isolated host cell comprising the nucleic acid of claim 1, or comprising an expression cassette, a vector or a cloning vehicle as set forth in claim 3, wherein the host cell is a bacterial cell, a mammalian cell, a fungal cell, a yeast cell, an insect cell or a plant cell.

5. A transgenic non-human animal, plant, plant part or plant seed comprising the nucleic acid of claim 1, wherein the plant is a corn plant, a sorghum plant, a potato plant, a tomato plant, a wheat plant, an oilseed plant, a rapeseed plant, a soybean plant, a rice plant, a barley plant, a grass, a cotton plant, a cottonseed plant, a palm, a sesame plant, a peanut plant, a sunflower plant or a tobacco plant.

6. A method of producing a recombinant polypeptide comprising (a) providing the nucleic acid of claim 1 or claim 2; and (b) expressing the nucleic acid of (a) under conditions that allow expression of the polypeptide, thereby producing a recombinant polypeptide, and the method further comprises transforming an isolated host cell with the nucleic acid of (a) followed by expressing the nucleic acid of (a), thereby producing a recombinant polypeptide in a transformed isolated host cell, or (II) (a) providing a vector comprising the nucleic acid of claim 1 or claim 2; and (b) expressing the vector of (a), wherein expression is effected by use of a high activity promoter, a dicistronic vector or by gene amplification of the vector.

* * * * *